(12) United States Patent
Gicquel et al.

(10) Patent No.: US 7,244,613 B2
(45) Date of Patent: Jul. 17, 2007

(54) POLYPEPTIDE NUCLEIC SEQUENCES EXPORTED FROM MYCOBACTERIA, VECTORS COMPRISING SAME AND USES FOR DIAGNOSING AND PREVENTING TUBERCULOSIS

(75) Inventors: Brigitte Gicquel, Paris (FR); Denis Portnoï, Paris (FR); Eng-Mong Lim, Paris (FR); Vladimir Pelicic, Paris (FR); Agnès Guigueno, Arras (FR); Yves Goguet De La Salmoniere, Paris (FR)

(73) Assignee: Institut Pasteur, Paris (FR)

( * ) Notice: Subject to any disclaimer, the term of this patent is extended or adjusted under 35 U.S.C. 154(b) by 948 days.

(21) Appl. No.: 09/855,604

(22) Filed: May 16, 2001
(Under 37 CFR 1.47)

(65) Prior Publication Data

US 2004/0214165 A1    Oct. 28, 2004
US 2005/0158714 A9    Jul. 21, 2005

Related U.S. Application Data

(63) Continuation of application No. 09/485,536, filed on Aug. 14, 1998, now abandoned, and a continuation-in-part of application No. PCT/FR98/01813, filed on Aug. 14, 1998.

(30) Foreign Application Priority Data

Aug. 14, 1997  (FR)  ................................... 97 10404
Sep. 11, 1997  (FR)  ................................... 97 11325

(51) Int. Cl.
*C12N 15/00*  (2006.01)
*C12N 15/09*  (2006.01)
*C12N 15/63*  (2006.01)
*C12N 15/70*  (2006.01)
*C12N 15/74*  (2006.01)

(52) U.S. Cl. ............................... 435/320.1; 435/253.1; 536/23.1

(58) Field of Classification Search ............. 435/320.1, 435/253.1; 536/23.1
See application file for complete search history.

(56) References Cited

U.S. PATENT DOCUMENTS 6,248,581 B1 *  6/2001  Gicquel et al. .......... 435/320.1

FOREIGN PATENT DOCUMENTS

FR       2 767 336      *  2/1999
WO   WO 9607745 A2   *  3/1996

* cited by examiner

*Primary Examiner*—James Ketter
*Assistant Examiner*—Konstantina Katcheves
(74) *Attorney, Agent, or Firm*—Finnegan, Henderson, Farabow, Garrett & Dunner, L.L.P.

(57) ABSTRACT

The invention concerns recombinant vectors replicated in mycobacteria, a set of sequences coding for exported polypeptides detected by fusion with alkaline phosphatase, in particular one polypeptide, called DP428, of about 12 kD corresponding to an exported protein found in mycobacteria belonging to the *Mycobacterium tuberculosis* complex. The invention also concerns methods and kits for detecting in vitro the presence of a *mycobacterium* and in particular a *mycobacterium* belonging to the *Mycobacterium tuberculosis* complex in a biological sample using said polypeptides, their fragments or polynucleotides coding for the latter. The invention also concerns immunogenic or vaccine compositions for preventing and/or treating infections caused by mycobacteria and in particular a *mycobacterium* belonging to said complex, particularly tuberculosis.

5 Claims, 185 Drawing Sheets

Figure 51A:
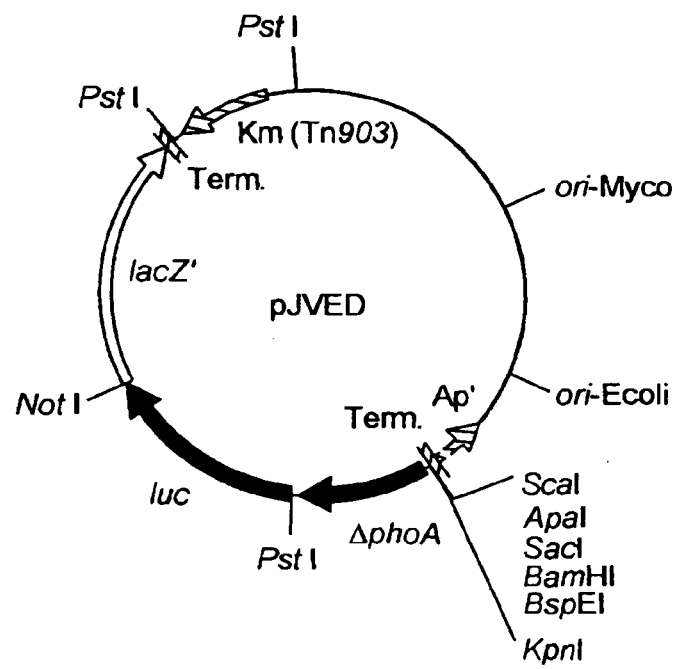

```
 SEQ ID NO: 1
 1 GGATCCCAGGGAACGTGACC ATG GTC GTA GGG ATG ACT TGA CAGTTTCAACGGGGTGCGACCACCGTTGCGC 72
 1                     (M   V   V   G   M   T)  *                                      7
SEQ ID NO: 2              SEQ ID NO: 3
 73 TCAGAAGGCATACGTTGGTGGAACACGTCGGAAAGCTGGGAGGTGAATCTG ATG GCT GGC GAC CAA GAG CTG 144
  1                                                     (M   A   G   D   Q   E   L   7
                                                         SEQ. ID NO: 4

145 GAA CTG CGG TTC GAC GTT CCT CTT TAC ACG CTT GCC GAG GCA TCG CGG TAC CTG GTG GTT 204
  8  E   L   R   F   D   V   P   L   Y   T   L   A   E   A   S   R   Y   L   V   V  27

205 CCC CGC GCC ACC CTG GCT ACG TGG GCT GAC GGC TAC GAG CGT CGG CCG GCC AAC GCA CCG 264
 28  P   R   A   T   L   A   T   W   A   D   G   Y   E   R   R   P   A   N   A   P  47

265 GCG GTC CAG GGG CAA CCG ATC GCC TTT GAC GCC TAT TCG GTC GCG CAG CTT TTT GGC GAC 324
 48  A   V   Q   G   Q   P   I   A   F   D   A   Y   S   V   A   Q   L   F   G   D  67

325 GTC ACT GGT GCC CGC GTT GCG GGC GTC CAG CCG CAG CGA CAC CAC ATA CGG CCG GTC CGG 384
 68  V   T   G   A   R   V   A   G   V   Q   P   Q   R   H   H   I   R   P   V   R  87

385 TTG CGG GGG CCG TTG GGT GGG GTT GGG TGC CTC CGT CAC CCC AGG CAG TTC GCT GGC TAT 444
 88  L   R   G   P   L   G   G   V   G   C   L   R   H   P   R   Q   F   A   G   Y 107

445 TTG TCG CAG TAG CGCGACGGCATTGTCATG TCT TGG TAG CTAGCATCCGGTCGGGGGGCCGCTACCAGCG 515
108  L   S   Q)  *                      M   S   W   *                                 4

516 CCAGCGCCGGGGCTCCCCGGTCCGGGTAGTGCGCGTCGAGTTGGTCGTGGACCAGCA ATG ACT GCG ACC CGG 587
  1                                                           (M   T   A   T   R   5
                                         SEQ. ID NO: 5

588 CGA CTT CGA AAC CGC CAC CGG TTA GAT TCC CCG ACT GCG TCA TCG CCA GGT AAA CCG CCG 647
  6  R   L   R   N   R   H   R   L   D   S   P   T   A   S   S   P   G   K   P   P  25

648 GCA CTA ACG CCA GCA ACC AAC CCG TGA AGACCAACCAACGGCACCTGCGCAGGTTGCGGCTCAACCGCATC 718
 26  A   L   T   P   A   T   N   P)  *                                                34

719 ATG AAC TGC TGG ATT TCG GAC TCC CCG TAC TCT CGC GCA GTG CGT GCC CGC GAG CCT ACC 778
  1 (M   N   C   W   I   S   D   S   P   Y   S   R   A   V   R   A   R   E   P   T  20
 SEQ ID NO: 6
779 GAA GAT CGC GTG CAT GCG TTC GGC GTG GAC CGC ACA GCA CCT GGA GTT GGC GGC GCC GAG 838
 21  E   D   R   V   H   A   F   G   V   D   R   T   A   P   G   V   G   G   A   E  40

839 GGC CGA GAT GGC AGG ATG ACG GAT CGT CGG GGG CGG GAA CTC CCA GGC CGC CGG ACC GTC 898
 41  G   R   D   G   R   M   T   D   R   R   G   R   E   L   P   G   R   R   T   V  60

899 GCA AAC CCG TCG CAA ACC CGT CGC AAA CCG TAA GGAGTCATCC ATG AAG ACA GGC ACC GCG 959
 61  A   N   P   S   Q   T   R   R   K   P)  *              (M   K   T   G   T   A   6
                                                              SEQ. ID NO: 7
960 ACG ACG CGG CGC AGG CTG TTG GCA GTA CTG ATC GCC CTC GCG TTG CCG GGG GCC GCC GTT 1019
  7  T   T   R   R   R   L   L   A   V   L   I   A   L   A   L   P   G   A   A   V  26

1020 GCG CTG CTG GCC GAA CCA TCA GCG ACC GGC GCG TCG GAC CCG TGC GCG GCC AGC GAA GTG 1079
 27   A   L   L   A   E   P   S   A   T   G   A   S   D   P   C   A   A   S   E   V  46

1080 GCG AGG ACG GTC GGT TCG GTC GCC AAG TCG ATG GGC GAC TAC CTG GAT TCA CAC CCA GAG 1139
 47   A   R   T   V   G   S   V   A   K   S   M   G   D   Y   L   D   S   H   P   E  66

1140 ACC AAC CAG GTG ATG ACC GCG GTC TTG CAG CAG CAG GTA GGG CCG GGG TCG GTC GCA TCG 1199
 67   T   N   Q   V   M   T   A   V   L   Q   Q   Q   V   G   P   G   S   V   A   S  86

1200 CTG AAG GCC CAT TTC GAG GCG AAT CCC AAG GTC GCA TCG GAT CC                     1243
 87   L   K   A   H   F   E   A   N   P   K   V   A   S   D)                        100
```

SEQ ID NOS.1-7

FIG. 1

Insert of the clone containing DP428 and contained in seq1
1/1
⎡SEQ ID NO: 8                              31/11
GAT CGC CTT TGA CGC CTA TTC GGT CGC GCA GCT TTT TGG CGA CGT CAC TGG TGC CCG CGT
asp arg leu OPA(arg leu phe gly arg ala ala phe trp arg arg his trp cys pro arg
61/21            ⎡SEQ ID NO: 9              91/31
TGC GGG CGT CCA GCC GCA GCG ACA CCA CAT ACG GCC GGT CCG GTT GCG GGG GCC GTT GGG
cys gly arg pro ala ala ala thr pro his thr ala gly pro val ala gly ala val gly
121/41                                     151/51
TGG GGT TGG GTG CCT CCG TCA CCC CAG GCA GTT CGC TGG CTA TTT GTC GCA GTA GCG CGA
trp gly trp val pro pro ser pro gln ala val arg trp leu phe val ala val ala arg
181/61                                     211/71
CGG CAT TGT CGA TGT CTT GGT AGC TAG CAT CCG GTC GGG GGG CCG CTA CCA GCG CCA GCG
arg his cys arg cys leu gly ser)AMB(his pro val gly gly pro leu pro ala pro ala
241/81           SEQ ID NO: 10⎯⎯⎯⎯⎤         271/91
CCG GGG CTC CCC GGT CCG GGT AGT GCG CGT CGA GTT GGT CGT GGA CCA GCA ATG ACT GCG
pro gly leu pro gly pro gly ser ala arg arg val gly arg gly pro ala met thr ala
301/101                                    331/111
ACC CGG CGA CTT CGA AAC CGC CAC CGG TTA GAT TCC CCG ACT GCG TCA TCG CCA GGT AAA
thr arg arg leu arg asn arg his arg leu asp ser pro thr ala ser ser pro gly lys
361/121                                    391/131
CCG CCG GCA CTA ACG CCA GCA ACC AAC CCG TGA AGA CCA ACC AAC GGC ACC TGC GCA GGT
pro pro ala leu thr pro ala thr asn pro)OPA(arg pro thr asn gly thr cys ala gly
421/141                                    451/151⎡SEQ ID NO: 11
TGC GGC TCA ACC GCA TCA TGA ACT GCT GGA TTT CGG ACT CCC CGT ACT CTC GCG CAG TGC
cys gly ser thr ala ser)OPA(thr ala gly phe arg thr pro arg thr leu ala gln cys
481/161          SEQ ID NO: 12⎯⎯⎯⎤          511/171
GTG CCC GCG AGC CTA CCA AGA TCG CGT GCA TGC GTT CGG CGT GGA CCA GCA CAG CAC CTG
val pro ala ser leu pro lys ile ala cys met arg ser ala trp thr ala gln his leu
541/181                                    571/191
GAG TTG GCG GCG CCG AGG GCC GAG ATG GCA GGA TGA CGG ATC GTC GGG GGC GGG AAC TCC
glu leu ala ala pro arg ala glu met ala gly)OPA(arg ile val gly gly gly asn ser
601/201                                    631/211 ⎡SEQ ID NO: 13
CAG GCC GCC GGA CCG TCG CAA ACC CGT CGC AAA CCC GTC GCA AAC CGT AAG GAG TCA TCC
gln ala ala gly pro ser gln thr arg arg lys pro val ala asn arg lys glu ser ser
661/221                                    691/231
ATG AAG ACA GGC ACC GCG ACG ACG CGG CGC AGG CTG TTG GCA GTA CTG ATC GCC CTC GCG
met lys thr gly thr ala thr thr arg arg arg leu leu ala val leu ile ala leu ala
721/241                                    751/251
TTG CCG GGG GCC GCC GTT GCG CTG CTG GCC GAA CCA TCA GCG ACC GGC GCG TCG GAC CCG
leu pro gly ala ala val ala leu leu ala glu pro ser ala thr gly ala ser asp pro
781/261                                    811/271
TGC GCG GCC AGC GAA GTG GCG AGG ACG GTC GGT TCG GTC GCC AAG TCG ATG GGC GAC TAC
cys ala ala ser glu val ala arg thr val gly ser val ala lys ser met gly asp tyr
841/281                                    871/291
CTG GAT TCA CAC CCA GAG ACC AAC CAG GTG ATG ACC GCG GTC TTG CAG CAG CAG GTA GGG
leu asp ser his pro glu thr asn gln val met thr ala val leu gln gln gln val gly
901/301                                    931/311
CCG GGG TCG GTC GCA TCG CTG AAG GCC CAT TTC GAG GCG AAT CCC AAG GTC GCA TCG GAT C
pro gly ser val ala ser leu lys ala his phe glu ala asn pro lys val ala ser asp)

SEQ ID NOS:8-13

FIG. 1A'

Insert of the clone containing DP428, other reading frame

```
2/1    SEQ ID NO: 14                              32/11
ATC GCC TTT GAC GCC TAT TCG GTC GCG CAG CTT TTT GGC GAC GTC ACT GGT GCC CGC GTT
(ile ala phe asp ala tyr ser val ala gln leu phe gly asp val thr gly ala arg val
62/21   SEQ ID NO: 15                             92/31
GCG GGC GTC CAG CCG CAG CGA CAC CAC ATA CGG CCG GTC CGG TTG CGG GGG CCG TTG GGT
ala gly val gln pro gln arg his his ile arg pro val arg leu arg gly pro leu gly
122/41                                           152/51
GGG GTT GGG TGC CTC CGT CAC CCC AGG CAG TTC GCT GGC TAT TTG TCG CAG TAG CGC GAC
gly val gly cys leu arg his pro arg gln phe ala gly tyr leu ser gln)AMB(arg asp
182/61                                           212/71       SEQ ID NO: 16
GGC ATT GTC GAT GTC TTG GTA GCT AGC ATC CGG TCG GGG GGC CGC TAC CAG CGC CAG CGC
gly ile val asp val leu val ala ser ile arg ser gly gly arg tyr gln arg gln arg
242/81                                           272/91
CGG GGC TCC CCG GTC CGG GTA GTG CGC GTC GAG TTG GTC GTG GAC CAG CAA TGA CTG CGA
arg gly ser pro val arg val val arg val glu leu val val asp gln gln)OPA(leu arg
302/101                                          332/111      SEQ ID NO: 17
CCC GGC GAC TTC GAA ACC GCC ACC GGT TAG ATT CCC CGA CTG CGT CAT CGC CAG GTA AAC
pro gly asp phe glu thr ala thr gly)AMB(ile pro arg leu arg his arg gln val asn
362/121         SEQ ID NO: 18              392/131
CGC CGG CAC TAA CGC CAG CAA CCA ACC CGT GAA GAC CAA CCA ACG GCA CCT GCG CAG GTT
arg arg his)OCH(arg gln gln pro thr arg glu asp gln pro thr ala pro ala gln val
422/141          SEQ ID NO: 19                   452/151
GCG GCT CAA CCG CAT CAT GAA CTG CTG GAT TTC GGA CTC CCC GTA CTC TCG CGC AGT GCG
ala ala gln pro his his glu leu leu asp phe gly leu pro val leu ser arg ser ala
482/161                                          512/171
TGC CCG CGA GCC TAC CGA AGA TCG CGT GCA TGC GTT CGG CGT GGA CCG CAC AGC ACC TGG
cys pro arg ala tyr arg arg ser arg ala cys val arg arg gly pro his ser thr trp
542/181                                          572/191
AGT TGG CGG CGC CGA GGG CCG AGA TGG CAG GAT GAC GGA TCG TCG GGG GCG GGA ACT CCC
ser trp arg arg arg gly pro arg trp gln asp asp gly ser ser gly ala gly thr pro)
602/201                                          632/211
AGG CCG CCG GAC CGT CGC AAA CCC GTC GCA AAC CCG TCG CAA ACC GTA AGG AGT CAT CCA
arg pro pro asp arg arg lys pro val ala asn pro ser gln thr val arg ser his pro
662/221                                          692/231
TGA AGA CAG GCA CCG CGA CGA CGC GGC GCA GGC TGT TGG CAG TAC TGA TCG CCC TCG CGT
OPA(arg gln ala pro arg arg arg gly ala gly cys trp gln tyr)OPA(ser pro ser arg
722/241       SEQ ID NO: 20                      752/251      SEQ ID NO: 21
TGC CGG GGG CCG CCG TTG CGC TGC TGG CCG AAC CAT CAG CGA CCG GCG CGT CGG ACC CGT
cys arg gly pro pro leu arg cys trp pro asn his gln arg pro ala arg arg thr arg
782/261                                          812/271
GCG CGG CCA GCG AAG TGG CGA GGA CGG TCG GTT CGG TCG CCA AGT CGA TGG GCG ACT ACC
ala arg pro ala lys trp arg gly arg ser val arg ser pro ser arg trp ala thr thr
842/281                                          872/291
TGG ATT CAC ACC CAG AGA CCA ACC AGG TGA TGA CCG CGG TCT TGC AGC AGC AGG TAG GGC
trp ile his thr gln arg pro thr arg)OPA OPA(pro arg ser cys ser ser arg)AMB(gly
902/301               SEQ ID NO: 22        932/311              SEQ ID NO: 23
CGG GGT CGG TCG CAT CGC TGA AGG CCC ATT CGG CGA ATC CCA AGG TCG CAT CGG ATC
arg gly arg ser his arg)OPA(arg pro ile ser arg ile pro arg ser his arg ile)
                    SEQ ID NO: 24
```

SEQ ID NOS: 14-24

FIG. 1B'

SeqlC: Insert of the DP428 clone, other reading frame
3/1 SEQ ID NO: 25                                    33/11
TCG CCT TTG ACG CCT ATT CGG TCG CGC AGC TTT TTG GCG ACG TCA CTG GTG CCC GCG TTG
(ser pro leu thr pro ile arg ser arg ser phe leu ala thr ser leu val pro ala leu
63/21  SEQ ID NO: 26                                 93/31
CGG GCG TCC AGC CGC AGC GAC ACC ACA TAC GGC CGG TCC GGT TGC GGG GGC CGT TGG GTG
arg ala ser ser arg ser asp thr thr tyr gly arg ser gly cys gly gly arg trp val
123/41                                               153/51
GGG TTG GGT GCC TCC GTC ACC CCA GGC AGT TCG CTG GCT ATT TGT CGC AGT AGC GCG ACG
gly leu gly ala ser val thr pro gly ser ser leu ala ile cys arg ser ser ala thr
183/61                                               213/71
GCA TTG TCG ATG TCT TGG TAG CTA GCA TCC GGT CGG GGG GCC GCT ACC AGC GCC AGC GCC
ala leu ser met ser trp)AMB(leu ala ser gly arg gly ala ala thr ser ala ser ala
243/81     SEQ ID NO: 27                             273/91
GGG GCT CCC CGG TCC GGG TAG TGC GCG TCG AGT TGG TCG TGG ACC AGC AAT GAC TGC GAC
gly ala pro arg ser gly)AMB(cys ala ser ser trp ser trp thr ser asn asp cys asp
303/101         SEQ ID NO: 28                        333/111
CCG GCG ACT TCG AAA CCG CCA CCG GTT AGA TTC CCC GAC TGC GTC ATC GCC AGG TAA ACC
pro ala thr ser lys pro pro pro val arg phe pro asp cys val ile ala arg)OCH(thr
363/121                                              393/131     SEQ ID NO: 29
GCC GGC ACT AAC GCC AGC AAC CAA CCC GTG AAG ACC AAC CAA CGG CAC CTG CGC AGG TTG
ala gly thr asn ala ser asn gln pro val lys thr asn gln arg his leu arg arg leu
423/141                                              453/151
CGG CTC AAC CGC ATC ATG AAC TGC TGG ATT TCG GAC TCC CCG TAC TCT CGC GCA GTG CGT
arg leu asn arg ile met asn cys trp ile ser asp ser pro tyr ser arg ala val arg
483/161                                              513/171
GCC CGC GAG CCT ACC GAA GAT CGC GTG CAT GCG TTC GGC GTG GAC CGC ACA GCA CCT GGA
ala arg glu pro thr glu asp arg val his ala phe gly val asp arg thr ala pro gly
543/181                                              573/191
GTT GGC GGC GCC GAG GGC CGA GAT GGC AGG ATG ACG GAT CGT CGG GGG CGG GAA CTC CCA
val gly gly ala glu gly arg asp gly arg met thr asp arg arg gly arg glu leu pro
603/201                                              633/211
GGC CGC CGG ACC GTC GCA AAC CCG TCG CAA ACC CGT CGC AAA CCG TAA GGA GTC ATC CAT
gly arg arg thr val ala asn pro ser gln thr arg arg lys pro)OCH(gly val ile his
663/221                                              693/231     SEQ ID NO: 30
GAA GAC AGG CAC CGC GAC GAC GCG GCG CAG GCT GTT GGC AGT ACT GAT CGC CCT CGC GTT
glu asp arg his arg asp asp ala ala gln ala val gly ser thr asp arg pro arg val
723/241                                              753/251
GCC GGG GGC CGC CGT TGC GCT GCT GGC CGA ACC ATC AGC GAC CGG CGC GTC GGA CCC GTG
ala gly gly arg arg cys ala ala gly arg thr ile ser asp arg arg val gly pro val
783/261                                              813/271
CGC GGC CAG CGA AGT GGC GAG GAC GGT CGG TTC GGT CGC CAA GTC GAT GGG CGA CTA CCT
arg gly gln arg ser gly glu asp gly arg phe gly arg gln val asp gly arg leu pro
843/281                                              873/291
GGA TTC ACA CCC AGA GAC CAA CCA GGT GAT GAC CGC GGT CTT GCA GCA GCA GGT AGG GCC
gly phe thr pro arg asp gln pro gly asp asp arg gly leu ala ala ala gly arg ala
903/301                                              933/311
GGG GTC GGT CGC ATC GCT GAA GGC CCA TTT CGA GGC GAA TCC CAA GGT GCG ATC GGA TC
gly val gly arg ile ala glu gly pro phe arg gly glu ser gln gly arg ile gly)

SEQ ID NOS: 25-30

FIG. 1C'

Coding sequence DP428 identical to the Rv0203 predicted by Cole et al.
(Nature 393:537-544)

```
1/1    SEQ ID NO: 31                              31/11
ATG AAG ACA GGC ACC GCG ACG ACG CGG CGC AGG CTG TTG GCA GTA CTG ATC GCC CTC GCG
(Met lys thr gly thr ala thr thr arg arg arg leu leu ala val leu ile ala leu ala
61/21    SEQ ID NO: 32                            91/31
TTG CCG GGG GCC GCC GTT GCG CTG CTG GCC GAA CCA TCA GCG ACC GGC GCG TCG GAC CCG
leu pro gly ala ala val ala leu leu ala glu pro ser ala thr gly ala ser asp pro
121/41                                            151/51
TGC GCG GCC AGC GAA GTG GCG AGG ACG GTC GGT TCG GTC GCC AAG TCG ATG GGC GAC TAC
cys ala ala ser glu val ala arg thr val gly ser val ala lys ser met gly asp tyr
181/61                                            211/71
CTG GAT TCA CAC CCA GAG ACC AAC CAG GTG ATG ACC GCG GTC TTG CAG CAG CAG GTA GGG
leu asp ser his pro glu thr asn gln val met thr ala val leu gln gln gln val gly
241/81                                            271/91
CCG GGG TCG GTC GCA TCG CTG AAG GCC CAT TTC GAG GCG AAT CCC AAG GTC GCA TCG GAT
pro gly ser val ala ser leu lys ala his phe glu ala asn pro lys val ala ser asp
301/101                                           331/111
CTG CAC GCG CTT TCG CAA CCG CTG ACC GAT CTT TCG ACT CGG TGC TCG CTG CCG ATC AGC
leu his ala leu ser gln pro leu thr asp leu ser thr arg cys ser leu pro ile ser
361/121                                           391/131
GGC CTG CAG GCG ATC GGT TTG ATG CAG GCG GTG CAG GGC GCC CGC CGG TAG
gly leu gln ala ile gly leu met gln ala val gln gly ala arg arg) AMB
```

SEQ ID NOS:31-32

FIG. 1D'

ORF containing the DP428 sequence and forming part of seqlA'

```
1/1    SEQ ID NO: 33                              31/11
TGA CGG ATC GTC GGG GGC GGG AAC TCC CAG GCC GCC GGA CCG TCG CAA ACC CGT CGC AAA
OPA(arg ile val gly gly gly asn ser gln ala ala gly pro ser gln thr arg arg lys
61/21    SEQ ID NO: 34                            91/31
CCC GTC GCA AAC CGT AAG GAG TCA TCC ATG AAG ACA GGC ACC GCG ACG ACG CGG CGC AGG
pro val ala asn arg lys glu ser ser met lys thr gly thr ala thr thr arg arg arg
121/41                                            151/51
CTG TTG GCA GTA CTG ATC GCC CTC GCG TTG CCG GGG GCC GCC GTT GCG CTG CTG GCC GAA
leu leu ala val leu ile ala leu ala leu pro gly ala ala val ala leu leu ala glu
181/61                                            211/71
CCA TCA GCG ACC GGC GCG TCG GAC CCG TGC GCG GCC AGC GAA GTG GCG AGG ACG GTC GGT
pro ser ala thr gly ala ser asp pro cys ala ala ser glu val ala arg thr val gly
241/81                                            271/91
TCG GTC GCC AAG TCG ATG GGC GAC TAC CTG GAT TCA CAC CCA GAG ACC AAC CAG GTG ATG
ser val ala lys ser met gly asp tyr leu asp ser his pro glu thr asn gln val met
301/101                                           331/111
ACC GCG GTC TTG CAG CAG CAG GTA GGG CCG GGG TCG GTC GCA TCG CTG AAG GCC CAT TTC
thr ala val leu gln gln gln val gly pro gly ser val ala ser leu lys ala his phe
361/121                                           391/131
GAG GCG AAT CCC AAG GTC GCA TCG GAT CTG CAC GCG CTT TCG CAA CCG CTG ACC GAT CTT
glu ala asn pro lys val ala ser asp leu his ala leu ser gln pro leu thr asp leu
421/141                                           451/151
TCG ACT CGG TGC TCG CTG CCG ATC AGC GGC CTG CAG GCG ATC GGT TTG ATG CAG GCG GTG
ser thr arg cys ser leu pro ile ser gly leu gln ala ile gly leu met gln ala val
481/161
CAG GGC GCC CGC CGG TAG
gln gly ala arg arg) AMB
```

SEQ ID NOS:33-34

FIG. 1E'

```
491 CCGGTCGGGGGGCCGCTACCAGCGCCAGCGCCGGGGCTCCCCGGTCCGGGTA GTG CGC GTC GAG TTG GTC GTG 563
    1 SEQ ID NO: 35           SEQ ID NO: 37 ────────▶(V  R   V   E   L   V   V   7

564 GAC CAG CAA TGA CTGCGACCCGGCGACTTCGAAACCGCCACCGGTTAGATTCCCCGACTGCGTCATCGCCAGGTAA 639
  8 D   Q   Q)  *  SEQ ID NO: 36

640 ACCGCCGGCACTAACGCCAGCAACCAACCC GTG AAG ACC AAC CAA CGG CAC CTG CGC AGG TTG CGG   705
    1  SEQ ID NO: 38 ──────────▶(V  K   T   N   Q   R   H   L   R   R   L   R    12

706 CTC AAC CGC ATC ATG AAC TGC TGG ATT TCG GAC TCC CCG TAC TCT CGC GCA GTG CGT GCC 765
 13  L   N   R   I   M   N   C   W   I   S   D   S   P   Y   S   R   A   V   R   A   32

766 CGC GAG CCT ACC GAA GAT CGC GTG CAT GCG TTC GGC GTG GAC CGC ACA GCA CCT GGA GTT 825
 33  R   E   P   T   E   D   R   V   H   A   F   G   V   D   R   T   A   P   G   V   52

826 GGC GGC GCC GAG GGC CGA GAT GGC AGG ATG ACG GAT CGT CGG GGG CGG GAA CTC CCA GGC 885
 53  G   G   A   E   G   R   D   G   R   M   T   D   R   R   G   R   E   L   P   G   72

886 CGC CGG ACC GTC GCA AAC CCG TCG CAA ACC CGT CGC AAA CCG TAA GGAGTCATCC ATG AAG   946
 73  R   R   T   V   A   N   P   S   Q   T   R   K   P)  *  xxxxxx        (M   K    2
                                                         SEQ ID NO: 39

947 ACA GGC ACC GCG ACG ACG CGG CGC AGG CTG TTG GCA GTA CTG ATC GCC CTC GCG TTG CCG 1006
  3  T   G   T   A   T   T   R   R   R   L   L   A   V   L   I   A   L   A   L   P   22

1007 GGG GCC GCC GTT GCG CTG CTG GCC GAA CCA TCA GCG ACC GGC GCG TCG GAC CCG TGC GCG 1066
 23   G   A   A   V   A   L   L   A   E   P   S   A   T   G   A   S   D   P   C   A   42

1067 GCC AGC GAA GTG GCG AGG ACG GTC GGT TCG GTC GCC AAG TCG ATG GGC GAC TAC CTG GAT 1126
 43   A   S   E   V   A   R   T   V   G   S   V   A   K   S   M   G   D   Y   L   D   62

1127 TCA CAC CCA GAG ACC AAC CAG GTG ATG ACC GCG GTC TTG CAG CAG CAG GTA GGG CCG GGG 1186
 63   S   H   P   E   T   N   Q   V   M   T   A   V   L   Q   Q   Q   V   G   P   G   82

1187 TCG GTC GCA TCG CTG AAG GCC CAT TTC GAG GCG AAT CCC AAG GTC GCA TCG GAT CTG CAC 1246
 83   S   V   A   S   L   K   A   H   F   E   A   N   P   K   V   A   S   D   L   H  102

1247 GCG CTT TCG CAA CCG CTG ACC GAT CTT TCG ACT CGG TGC TCG CTG CCG ATC AGC GGC CTG 1306
103   A   L   S   Q   P   L   T   D   L   S   T   R   C   S   L   P   I   S   G   L  122

1307 CAG GCG ATC GGT TTG ATG CAG GCG GTG CAG GGC GCC CGC CGG TAG ATG CCG GAC CGC CGC 1366
123   Q   A   I   G   L   M   Q   A   V   Q   G   A   R   R)   *  (M   P   D   R   R   5
                                                                  SEQ ID NO: 40
1367 CGG GTC CGG CGC AGT CGA CGT GAG GCA GCG GTC GCC TAC CGG GGC GGT GTC TCG CCG CCT 1426
  6   R   V   R   R   S   R   R   E   A   A   V   A   Y   R   G   G   V   S   P   P   25

1427 TCT GGT CGC AGG TCA GGG GTC GGC GCT GGA CCT TGC GGT GTG GTT TCG ACC GGG TCG TCG 1486
 26   S   G   R   R   S   G   V   G   A   G   P   C   G   V   V   S   T   G   S   S   45

1487 CAG GGT GTG CCC TGC GGT TGG ATG ACA AGT CGC AGG TTT GGA TCG GTT GGC GGG TCG CGA 1546
 46   Q   G   V   P   C   G   W   M   T   S   R   R   F   G   S   V   G   G   S   R   65

1547 TCG TTG T                                                                       1553
 66   S   L)                                                                          67
```

SEQ ID NOS:35-40

FIG. 2

SEQ ID NO: 41                                    31/11
TCG CCG GCT CGC GGA CGT AGA TAA TAG CTC ACC GTT GGA CGA CCT CGA CAG GGT CCT TTG
(ser pro ala arg gly arg arg)OCH AMB(leu thr val gly arg pro arg gln gly pro leu)
61/21  SEQ ID NO: 42   SEQ ID NO: 43   91/31
TGA CTG CCG GGC TTG ACG CGG ACG ACC ACA GAG TCG GGT CAT CGC CTA AGG CTA CCG TTC
OPA(leu pro gly leu thr arg thr thr thr glu ser gly his arg leu arg leu pro phe)
121/41  SEQ ID NO: 44                  151/51
TGA CCT GGG GTG CGT GGG CGC CGA CGA GTG AGG CAG TCA TGT CTC AGG GCC CAC CGC CAC
OPA(pro gly val arg gly arg arg arg val arg gln ser cys leu arg ala his arg his
181/61  SEQ ID NO: 45                  211/71
CTC GGT CGC CGG CAG TGT CAG CAT GTG CAG ATG ACT CCA CGC AGC TTG TTC GTG TTG GTG
leu gly arg arg gln cys gln his val gln met thr pro arg ser leu phe val leu val
241/81                                 271/91
TCG TGG TTG CGA CGA CTT GGC GCT GGT GAG CGC ACC CGC CGG CGT CGT GCC GCG CAT GCG
ser trp leu arg arg leu gly ala gly glu arg thr arg arg arg arg ala ala his ala
301/101
GAT C
asp)

SEQ ID NOS:41-45

FIG. 3A

SEQ ID NO: 46                                    32/11
CGC CGG CTC GCG GAC GTA GAT AAT AGC TCA CCG TTG GAC GAC CTC GAC AGG GTC CTT TGT
(arg arg leu ala asp val asp asn ser ser pro leu asp asp leu asp arg val leu cys
62/21   SEQ ID NO: 47                  92/31
GAC TGC CGG GCT TGA CGC GGA CGA CCA CAG AGT CGG GTC ATC GCC TAA GGC TAC CGT TCT
asp cys arg ala)OPA(arg gly arg pro gln ser arg val ile ala)OCH(gly tyr arg ser
122/41           SEQ ID NO: 48  152/51                        SEQ ID NO: 49
GAC CTG GGG TGC GTG GGC GCC GAC GAG TGA GGC AGT CAT GTC TCA GGG CCC ACC GCC ACC
asp leu gly cys val gly ala asp glu)OPA(gly ser his val ser gly pro thr ala thr
182/61          SEQ ID NO: 50   212/71
TCG GTC GCC GGC AGT GTC AGC ATG TGC AGA TGA CTC CAC GCA GCT TGT CGT GTT GGT GTT
ser val ala gly ser val ser met cys arg)OPA(leu his ala ala cys ser cys trp cys
242/81                                 272/91  SEQ ID NO: 51
CGT GGT TGC GAC GAC TTG GCG CTG GTG AGC GCA CCC GCC GGC GTC GTG CCG CGC ATG CGG
arg gly cys asp asp leu ala leu val ser ala pro ala gly val val pro arg met arg
302/101
ATC
ile)

SEQ ID NOS:46-51

FIG. 3B

```
 ┌SEQ ID NO: 52                                   33/11
 GCC GGC TCG CGG ACG TAG ATA ATA GCT CAC CGT TGG ACG ACC TCG ACA GGG TCC TTT GTG
 (ala gly ser arg thr)AMB(ile ile ala his arg trp thr thr ser thr gly ser phe val
  63/21 ─SEQ ID NO: 53    ┌SEQ ID NO: 54          93/31
 ACT GCC GGG CTT GAC GCG GAC GAC CAC AGA GTC GGG TCA TCG CCT AAG GCT ACC GTT CTG
 thr ala gly leu asp ala asp asp his arg val gly ser ser pro lys ala thr val leu
 123/41                                           153/51
 ACC TGG GGT GCG TGG GCG CCG ACG AGT GAG GCA GTC ATG TCT CAG GGC CCA CCG CCA CCT
 thr trp gly ala trp ala pro thr ser glu ala val met ser gln gly pro pro pro pro
 183/61                                           213/71
 CGG TCG CCG GCA GTG TCA GCA TGT GCA GAT GAC TCC ACG CAG CTT GTT CGT GTT GGT GTC
 arg ser pro ala val ser ala cys ala asp asp ser thr gln leu val arg val gly val
 243/81                                           273/91
 GTG GTT GCG ACG ACT TGG CGC TGG TGA GCG CAC CCG CCG GCG TCG TGC CGC GCA TGC GGA
 val val ala thr thr trp arg trp)OPA(ala his pro pro ala ser cys arg ala cys gly)
                                       └SEQ ID NO: 55
 TC
```

SEQ ID NOS:52-55

FIG. 3C

```
 ┌─SEQ ID NO: 56                                  31/11
 CCA ATT TTC CTT CGC GCC GTG CAA TAC CAT CTG CAA GAC CAG CGA CGG CCC GTG GTT GCG
 (pro ile phe leu arg ala val gln tyr his leu gln asp gln arg arg pro val val ala
  61/21 ─SEQ ID NO: 57                            91/31
 GTC GCG CAG CTT GCG GAA ACC GGG TAT GGA CCC TGC CGT ACC GTT GTT GCC ACT TGA TGT
 val ala gln leu ala glu thr gly tyr gly pro cys arg thr val val ala thr)OPA(cys
 121/41                                           151/51           SEQ ID NO: 58─┘
 CGT CGC TCT CCA CCC GTC GGG GGG CGA AAG CCA TTC CGA CAC TGG GAT CCT CAA AAC GTC
 arg arg ser pro pro val gly gly arg lys pro phe arg his trp asp pro gln asn val
 181/61                                           211/71
 GGC TGA GTG TCT GCA GGG CTC CGG GGA GCA GCC GAT CAT CAC CAT GTA CGA ACT GAA TAA
 gly)OPA(val ser ala gly leu arg gly ala ala asp his his his val arg thr glu)OCH
 241/81      └─SEQ ID NO: 59                      271/91
 GTC CCC CGC GCG CGA CTT CCA GAC ATT TGT TGT GGT TTC GGT TGA GGC CGA GGC GAG GCT
 (val pro arg ala arg leu pro asp ile cys cys gly phe gly)OPA(gly arg gly glu ala
 301/101 ─SEQ ID NO: 60                   331/111             └─SEQ ID NO: 61
 CAT TTC GCA GCA ACC GGT CTC CGG GTC GCA GCA TCG TTG CGG CGA TCG CGG CGC AGT CGT
 his phe ala ala thr gly leu arg val ala ala ser leu arg arg ser arg arg ser arg
 361/121
 CGG ACG AGT CGT CGT CAA CGA CCA CGA TC
 arg thr ser arg arg gln arg pro arg)
```

SEQ ID NOS:56-61

FIG. 4A

```
                SEQ ID NO: 62                                32/11
CAA TTT TCC TTC GCG CCG TGC AAT ACC ATC TGC AAG ACC AGC GAC GGC CCG TGG TTG CGG
gln(phe ser phe ala pro cys asn thr ile cys lys thr ser asp gly pro trp leu arg
62/21     SEQ ID NO: 63                              92/31
TCG CGC AGC TTG CGG AAA CCG GGT ATG GAC CCT GCC GTA CCG TTG TTG CCA CTT GAT GTC
ser arg ser leu arg lys pro gly met asp pro ala val pro leu leu pro leu asp val
122/41                                              152/51
GTC GCT CTC CAC CCG TCG GGG GGC GAA AGC CAT TCC GAC ACT GGG ATC CTC AAA ACG TCG
val ala leu his pro ser gly gly glu ser his ser asp thr gly ile leu lys thr ser
182/61                                              212/71
GCT GAG TGT CTG CAG GGC TCC GGG GAG CAG CCG ATC ATC ACC ATG TAC GAA CTG AAT AAG
ala glu cys leu gln gly ser gly glu gln pro ile ile thr met tyr glu leu asn lys
242/81                                              272/91
TCC CCC GCG CGC GAC TTC CAG ACA TTT GTT GTG GTT TCG GTT GAG GCC GAG GCA AGG CTC
ser pro ala arg asp phe gln thr phe val val val ser val glu ala glu ala arg leu
302/101                                             332/111
ATT TCG CAG CAA CCG GTC TCC GGG TCG CAG CAT CGT TGC GGC GAT CGC GGC GCA GTC GTC
ile ser gln gln pro val ser gly ser gln his arg cys gly asp arg gly ala val val
362/121
GGA CGA GTC GTC GTC AAC GAC CAC GAT C
gly arg val val val asn asp his asp)
```

SEQ ID NOS:62-63

FIG. 4B

```
              SEQ ID NO:64                                 33/11
AAT TTT CCT TCG CGC CGT GCA ATA CCA TCT GCA AGA CCA GCG ACG GCC CGT GGT TGC GGT
(asn phe pro ser arg arg ala ile pro ser ala arg pro ala thr ala arg gly cys gly
63/21    SEQ ID NO: 65                               93/31
CGC GCA GCT TGC GGA AAC CGG GTA TGG ACC CTG CCG TAC CGT TGT TGC CAC TTG ATG TCG
arg ala ala cys gly asn arg val trp thr leu pro tyr arg cys cys his leu met ser
123/41                                              153/51
TCG CTC TCC ACC CGT CGG GGG GCG AAA GCC ATT CCG ACA CTG GGA TCC TCA AAA CGT CGG
ser leu ser thr arg arg gly ala lys ala ile pro thr leu gly ser ser lys arg arg
183/61                                              213/71
CTG AGT GTC TGC AGG GCT CCG GGG AGC AGC CGA TCA TCA CCA TGT ACG AAC TGA ATA AGT
leu ser val cys arg ala pro gly ser ser arg ser ser pro cys thr asn)OPA(ile ser
243/81                                   273/91          SEQ ID NO: 66
CCC CCG CGC GCG ACT TCC AGA CAT TTG TTG TGG TTT CGG TTG AGG CCG AGG CGA GGC TCA
pro pro arg ala thr ser arg his leu leu trp phe arg leu arg pro arg arg gly ser
303/101                                             333/111
TTT CGC AGC AAC CGG TCT CCG GGT CGC AGC ATC GTT GCG GCG ATC GCG GCA GTC GTC
phe arg ser asn arg ser pro gly arg ser ile val ala ala ile ala ala gln ser ser
363/121
GAC GAG TCG TCG TCA ACG ACC ACG ATC
asp glu ser ser ser thr thr thr ile)
```

SEQ ID NOS:64-66

FIG.4C part of the nucleotide sequence of seq4A

1/1 SEQ ID NO: 67                           31/11
CCG CGC GCG ACT TCC AGA CAT TTG TTG TGG TTT CGG TTG AGG CCG AGG CGA GGC TCA TTT
(pro arg ala thr ser arg his leu leu trp phe arg leu arg pro arg arg gly ser phe
61/21        SEQ ID NO: 68                  91/31
CGC AGC AAG CGG TCT CCG GGT CGC AGC ATC GTT GCG GCG ATC GCG GCG CAG TCG TCG GAC
arg ser lys arg ser pro gly arg ser ile val ala ala ile ala ala gln ser ser asp
121/41
GAG TCG TCG TCA ACG ACC ACG ATC
glu ser ser ser thr thr thr ile)

SEQ ID NOS:67-68

FIG.4A'

1/1 SEQ ID NO: 69                           31/11
CGC GCG CGA CTT CCA GAC ATT TGT TGT GGT TTC GGT TGA GGC CGA GGC GAG GCT CAT TTC
(arg ala arg leu pro asp ile cys cys gly phe gly)OPA(gly arg gly glu ala his phe
61/21        SEQ ID NO: 70                  91/31      SEQ ID NO: 71
GCA GCA AGC GGT CTC CGG GTC GCA GCA TCG TTG CGG CGA TCG CGG CGC AGT CGT CGG ACG
ala ala ser gly leu arg val ala ala ser leu arg arg ser arg arg ser arg arg thr
121/41
AGT CGT CGT CAA CGA CCA CGA TC
ser arg arg gln arg pro arg)

SEQ ID NOS:69-71

FIG.4B'

1/1 SEQ ID NO: 72                           31/11
GCC GCG CGC GAC TTC CAG ACA TTT GTT GTG GTT TCG GTT GAG GCC GAG GCG AGG CTC ATT
(ala ala arg asp phe gln thr phe val val val ser val glu ala glu ala arg leu ile
61/21        SEQ ID NO: 73                  91/31
TCG CAG CAA GCG GTC TCC GGG TCG CAG CAT CGT TGC GGC GAT CGC GGC GCA GTC GTC GGA
ser gln gln ala val ser gly ser gln his arg cys gly asp arg gly ala val val gly
121/41
CGA GTC GTC GTC AAC GAC CAC GAT C
arg val val val asn asp his asp

SEQ ID NOS:72-73

FIG. 4C'

ORF according to Cole et al. (Nature 393:537-544) and containing the
sequence Seq 4A'
1/1 ⎯ SEQ ID NO: 74                              31/11
tga ata agt ccg ccg cgc gcg act tcc aga cat ttg ttg tgg ttt cgg ttg agg ccg agg
OPA(ile ser pro pro arg ala thr ser arg his leu leu trp phe arg leu arg pro arg
61/21 ⎯ SEQ ID NO: 75                            91/31
cga ggc tca ttt cgc agc aag cgg tct ccg ggt cgc agc atc gtt gcg gcg atc gcg gcg
arg gly ser phe arg ser lys arg ser pro gly arg ser ile val ala ala ile ala ala
121/41                                           151/51
cag tcg tcg gac gag tcg tcg tca acg acc acg atc tcg aac tcg acg ccc tcc tgt tcg
gln ser ser asp glu ser ser ser thr thr thr ile ser asn ser thr pro ser cys ser
181/61                                           211/71
agg atg cta cgc aga cag cgc tcg atg gtg gcg ccg ttg ttg tac atc ggg atg cac acc
arg met leu arg arg gln arg ser met val ala pro leu leu tyr ile gly met his thr
241/81                                           271/91
gag ata agc ggt ttc gcc ggg ttc acc gat acc acg ctt gat gca tca cca ggc acc aca
glu ile ser gly phe ala gly phe thr asp thr thr leu asp ala ser pro gly thr thr
301/101
tgg cga ctc aga gac tag
trp arg leu arg asp) AMB

SEQ ID NOS:74-75

FIG. 4D' sequence upstream of seq4A' and fused with seq4A'
1/1 ⎯ SEQ ID NO: 76                              31/11
GCA ACC TAC CAG CAG AGC CAG GGG CTC ACA GGA CCT AAA GGA GTA GCG CCC ATG GCT GAT
(ala thr tyr gln gln ser gln gly leu thr gly pro lys gly val ala pro met ala asp)
⎯ SEQ ID NO: 77
C

SEQ ID NOS:76-77

FIG. 4E' seq4J' in another reading frame
1/1 ⎯ SEQ ID NO: 78                              31/11
ACG CAA CCT ACC AGC AGA GCC AGG GGC TCA CAG GAC CTA AAG GAG TAG CGC CCA TGG CTG
(thr gln pro thr ser arg ala arg gly ser gln asp leu lys glu)AMB(arg pro trp leu
61/21 ⎯ SEQ ID NO: 79                         SEQ ID NO: 80 ⎯
ATC
ile)

SEQ ID NOS:78-80

FIG. 4F' seq 4J' in the third reading frame
1/1 ⎯ SEQ ID NO: 81                              31/11
CGC AAC CTA CCA GCA GAG CCA GGG GCT CAC AGG ACC TAA GGA GTA GCG CCA TGG CTG A
(arg asn leu pro ala glu pro gly ala his arg thr)OCH(arg ser ser ala his gly)OPA
⎯ SEQ ID NO: 82              SEQ ID NO: 83 ⎯
TC

SEQ ID NOS:81-83

FIG. 4G' sequence Rv2050 predicted by Cole et al. (Nature 393:537-544) and
containing seq4J
1/1 — SEQ ID NO: 84                             31/11
ATG GCT GAT CGT GTC CTG AGG GGC AGT CGC CTC GGA GCC GTG AGC TAT GAG ACC GAC CGC
(Met ala asp arg val leu arg gly ser arg leu gly ala val ser tyr glu thr asp arg
61/21 — SEQ ID NO: 85                           91/31
AAC CAC GAC CTG GCG CCG CGC CAG ATC GCG CGG TAC CGC ACC GAC AAC GGC GAG GAG TTC
asn his asp leu ala pro arg gln ile ala arg tyr arg thr asp asn gly glu glu phe
121/41                                          151/51
GAA GTC CCG TTC GCC GAT GAC GCC GAG ATC CCC GGC ACC TGG TTG TGC CGC AAC GGC ATG
glu val pro phe ala asp asp ala glu ile pro gly thr trp leu cys arg asn gly met
181/61                                          211/71
GAA GGC ACC CTG ATC GAG GGC GAC CTG CCC GAG CCG AAG AAG GTT AAG CCG CCC CGG ACG
glu gly thr leu ile glu gly asp leu pro glu pro lys lys val lys pro pro arg thr
241/81                                          271/91
CAC TGG GAC ATG CTG CTG GAG CGC CGT TCC ATC GAA GAA CTC GAA GAG TTA CTT AAG GAG
his trp asp met leu leu glu arg arg ser ile glu glu leu glu glu leu leu lys glu
301/101                                         331/111
CGC CTC GAG CTC ATT CGG TCA CGT CGG CGC GGC TGA
arg leu glu leu ile arg ser arg arg arg gly)OPA

SEQ ID NOS:84-85

FIG. 4H'

ORF according to Cole et al. (Nature 393:537-544) and containing the
sequence Rv2050
1/1 — SEQ ID NO: 86                             31/11
TAG TCC GCC CGG GTG TCC GAT CCC GGT ATC ATT GAT GGT CGC GCC GCG CGC GTC GCG TGC
AMB(ser ala arg val ser asp pro gly ile ile asp gly arg ala ala arg val ala cys
61/21 — SEQ ID NO: 87                           91/31
CGG GAA CTA CGC AGA CGG CCG CAG CGT TTG CCA ACC GGA GCC AGT CGC CAG TAC GCA ACC
arg glu leu arg arg arg pro gln arg leu pro thr gly ala ser arg gln tyr ala thr
121/41                                          151/51
TAC CAG CAG AGC CCA GGG CTC ACA GGA CCT AAA GGA GTA GCG CCC ATG GCT GAT CGT GTC
tyr gln gln ser pro gly leu thr gly pro lys gly val ala pro met ala asp arg val
181/61                                          211/71
CTG AGG GGC AGT CGC CTC GGA GCC GTG AGC TAT GAG ACC GAC CGC AAC CAC GAC CTG GCG
leu arg gly ser arg leu gly ala val ser tyr glu thr asp arg asn his asp leu ala
241/81                                          271/91
CCG CGC CAG ATC GCG CGG TAC CGC ACC GAC AAC GGC GAG GAG TTC GAA GTC CCG TTC GCC
pro arg gln ile ala arg tyr arg thr asp asn gly glu glu phe glu val pro phe ala
301/101                                         331/111
GAT GAC GCC GAG ATC CCC GGC ACC TGG TTG TGC CGC AAC GGC ATG GAA GGC ACC CTG ATC
asp asp ala glu ile pro gly thr trp leu cys arg asn gly met glu gly thr leu ile
361/121                                         391/131
GAG GGC GAC CTG CCC GAG CCG AAG AAG GTT AAG CCG CCC CGG ACG CAC TGG GAC ATG CTG
glu gly asp leu pro glu pro lys lys val lys pro pro arg thr his trp asp met leu
421/141                                         451/151
CTG GAG CGC CGT TCC ATC GAA GAA CTC GAA GAG TTA CTT AAG GAG CGC CTC GAG CTC ATT
leu glu arg arg ser ile glu glu leu glu glu leu leu lys glu arg leu glu leu ile
481/161
CGG TCA CGT CGG CGC GGC TGA
arg ser arg arg arg gly)OPA

SEQ ID NOS 86-87

FIG. 4I'

SEQ ID NO: 88                                      31/11
GAT CGC GGT CAA CGA GGC CGA ATA CGG CGA GAT GTG GGC CCA AGA CGC CGC CGC GAT GTT
(asp arg gly gln arg gly arg ile arg arg asp val gly pro arg arg arg arg asp val
 61/21       SEQ ID NO:  89                        91/31
TGG CTA CGC CGC GGC GAC GGC GAC GGC GAC GGC GAC GTT GCT GCC GTT CGA GGA GGC GCC
trp leu arg arg gly asp gly asp gly asp gly asp val ala ala val arg gly gly ala
121/41                                             151/51
GGA GAT GAC CAG CGC GGG TGG GCT CCT CGA GCA GGC CGC CGC GGT CGA GGA GGC CTC CGA
gly asp asp gln arg gly trp ala pro arg ala gly arg arg gly arg gly gly leu arg
181/61                                             211/71
CAC CGC CGC GGC GAA CCA GTT GAT GAA CAA TGT GCC CCA GGC GCT GCA ACA GCT GGC CCA
his arg arg gly glu pro val asp glu gln cys ala pro gly ala ala thr ala gly pro
241/81                                             271/91
GCC CAC GCA GGG CAC CAC GCC TTC TTC CAA GCT GGG TGG CCT GTG GAA GAC GGT CTC GCC
ala his ala gly his his ala phe phe gln ala gly trp pro val glu asp gly leu ala
301/101
GCA TCG GTC GCC GAT C
ala ser val ala asp)

SEQ ID NOS. 88-89

FIG. 5A

SEQ ID NO: 90                                      32/11
ATC GCG GTC AAC GAG GCC GAA TAC GGC GAG ATG TGG GCC CAA GAC GCC GCC GCG ATG TTT
ile ala val asn glu ala glu tyr gly glu met trp ala gln asp ala ala ala met phe
 62/21       SEQ ID NO:  91                        92/31
GGC TAC GCC GCG GCG ACG GCG ACG GCG ACG GCG ACG TTG CTG CCG TTC GAG GAG GCG CCG
gly tyr ala ala ala thr ala thr ala thr ala thr leu leu pro phe glu glu ala pro
122/41                                             152/51
GAG ATG ACC AGC GCG GGT GGG CTC CTC GAG CAG GCC GCC GCG GTC GAG GAG GCC TCC GAC
glu met thr ser ala gly gly leu leu glu gln ala ala ala val glu glu ala ser asp
182/61                                             212/71
ACC GCC GCG GCG AAC CAG TTG ATG AAC AAT GTG CCC CAG GCG CTG CAA CAG CTG GCC CAG
thr ala ala ala asn gln leu met asn asn val pro gln ala leu gln gln leu ala gln
242/81                                             272/91
CCC ACG CAG GGC ACC ACG CCT TCT TCC AAG CTG GGT GGC CTG TGG AAG ACG TCG CCG
pro thr gln gly thr thr pro ser ser lys leu gly gly leu trp lys thr val ser pro
302/101
CAT CGG TCG CCG ATC
his arg ser pro ile

SEQ ID NOS. 90-91

FIG. 5B

```
                SEQ ID NO: 92                              33/11
              TCG CGG TCA ACG AGG CCG AAT ACG GCG AGA TGT GGG CCC AAG ACG CCG CCG CGA TGT TTG
              ser(arg ser thr arg pro asn thr ala arg cys gly pro lys thr pro pro arg cys leu
              63/21    SEQ ID NO: 93                                93/31
              GCT ACG CCG CGG CGA CGG CGA CGG CGA CGA CGT TGC TGC CGT TCG AGG AGG CGC CGG
              ala thr pro arg arg arg arg arg arg arg arg cys cys arg ser arg arg arg arg
              123/41                                      153/51
              AGA TGA CCA GCG CGG GTG GGC TCC TCG AGC AGG CCG CCG CGG TCG AGG AGG CCT CCG ACA
              arg)OPA(pro ala arg val gly ser ser ser arg pro pro arg ser arg arg pro pro thr
              183/61     SEQ ID NO: 94                    213/71
              CCG CCG CGG CGA ACC AGT TGA TGA ACA ATG TGC CCC AGG CGC TGC AAC AGC TGG CCC AGC
              pro pro arg arg thr ser)OPA OPA(thr met cys pro arg arg cys asn ser trp pro ser
              243/81           SEQ ID NO: 95              273/91
              CCA CGC AGG GCA CCA CGC CTT CTT CCA AGC TGG GTG GCC TGT GGA AGA CGG TCT CGC CGC
              pro arg arg ala pro arg leu leu pro ser trp val ala cys gly arg arg ser arg arg
              303/101
              ATC GGT CGC CGA TC
              ile gly arg arg)
```

SEQ ID NOS:92-95

FIG. 5C part of the nucleotide sequence Seq 5A

```
              1/1   SEQ ID NO: 96                         31/11
              CGC CGC GGC GAC GGC GAC GGC GAC GGC GAC GTT GCT GCC GTT CGA GGA GGC GCC GGA GAT
              arg arg gly asp gly asp gly asp gly asp val ala ala val arg gly gly ala gly asp
              61/21    SEQ ID NO: 97                      91/31
              GAC CAG CGC GGG TGG GCT CCT CGA GCA GGC CGC CGC GGT CGA GGA GGC CTC GAC ACC GC
              asp gln arg gly trp ala pro arg ala gly arg arg gly arg gly gly leu arg his arg
              121/41                                      151/51
              CGC GGC GAA CCA GTT GAT GAA CAA TGT GCC CCA GGC GCT GCA ACA GCT GGC CCA GCC CAC
              arg gly glu pro val asp glu gln cys ala pro gly ala ala thr ala gly pro ala his
              181/61                                      271/71
              GCA GGG CAC CAC GCC TTC TTC CAA GCT GGG TGG CCT GTG AAA GAC GGT CTC GCC GCA TCG
              ala gly his his ala phe phe gln ala gly trp pro val glu asp gly leu ala ala ser
              241/81
              GTC GCC GAT C
              val ala asp
```

SEQ ID NOS.96-97

FIG. 5A'

```
1/1   SEQ ID NO: 98                              31/11
TAC GCC GCG GCG ACG GCG ACG GCG ACG GCG ACG TTG CTG CCG TTC GAG GAG GCG CCG GAG
tyr ala ala ala thr ala thr ala thr ala thr leu leu pro phe glu glu ala pro glu
61/21   SEQ ID NO: 99                            91/31
ATG ACC AGC GCG GGT GGG CTC CTC GAG CAG GCC GCC GCG GTC GAG GAG GCC TCC GAC ACC
met thr ser ala gly gly leu leu glu gln ala ala ala val glu glu ala ser asp thr
121/41                                           151/51
GCC GCG GCG AAC CAG TTG ATG AAC AAT GTG CCC CAG GCG CTG CAA CAG CTG GCC CAG CCC
ala ala ala asn gln leu met asn asn val pro gln ala leu gln gln leu ala gln pro
181/61                                           211/71
ACG CAG GGC ACC ACG CCT TCT TCC AAG CTG GGT GGC CTG TGG AAG ACG GTC TCG CCG CAT
thr gln gly thr thr pro ser ser lys leu gly gly leu trp lys thr val ser pro his
241/81
CGG TCG CCG ATC
arg ser pro ile
```

SEQ ID NOS:98-99

FIG. 5B'

```
1/1   SEQ ID NO: 100                             31/11
ACG CCG CGG CGA CGG CGA CGG CGA CGG CGA CGT TGC TGC CGT TCG AGG AGG CGC CGG AGA
(thr pro arg arg arg arg arg arg arg arg arg cys cys arg ser arg arg arg arg arg)
61/21   SEQ ID NO: 101                           91/31
TGA CCA GCG CGG GTG GCT CCT CGA GCA GGC CGC CGG TCG AGG AGG CCT CCG ACA CCG
OPA(pro ala arg val gly ser ser ser arg pro pro arg ser arg arg pro pro thr pro
121/41   SEQ ID NO: 102                          151/51
CCG CGG CGA ACC AGT TGA TGA ACA ATG TGC CCC AGG CGC TGC AAC AGC TGG CCC AGC CA
pro arg arg thr ser)OPA OPA(thr met cys pro arg arg cys asn ser trp pro ser pro
181/61        SEQ ID NO: 103                     211/71
CGC AGG GCA CCA CGC CTT CTT CCA AGC TGG GTG GCC TGT GGA AGA CGG TCT CGC CGC ATC
arg arg ala pro arg leu leu pro ser trp val ala cys gly arg arg ser arg arg ile
241/81
GGT CGC CGA TC
gly arg arg)
```

SEQ ID NOS:100-103

FIG. 5C'

```
ORF predicted by Cole et al. (Nature 393:537-544) and containing seq5A'
1/1   SEQ ID NO: 104                    31/11
tga act gat gat tct gat agc gac caa cct ctt ggg gca aaa cac ccc ggc gat cgc ggt
OPA(thr asp asp ser asp ser asp gln pro leu gly ala lys his pro gly asp arg gly
61/21       SEQ ID NO: 105              91/31
caa cga ggc cga ata cgg cga gat gtg ggc cca aga cgc cgc cgc gat gtt tgg cta cgc
gln arg gly arg ile arg arg asp val gly pro arg arg arg arg asp val trp leu arg
121/41                                  151/51
cgc ggc gac ggc gac ggc gac ggc gac gtt gct gcc gtt cga gga ggc gcc gga gat gac
arg gly asp gly asp gly asp gly asp val ala ala val arg gly gly ala gly asp asp
181/61                                  211/71
cag cgc ggg tgg gct cct cga gca ggc cgc cgc ggt cga gga ggc ctc cga cac cgc cgc
gln arg gly trp ala pro arg ala gly arg arg gly arg gly gly leu arg his arg arg
241/81                                  271/91
ggc gaa cca gtt gat gaa caa tgt gcc cca ggc gct gca aca gct ggc cca gcc cac gca
gly glu pro val asp glu gln cys ala pro gly ala ala thr ala gly pro ala his ala
301/101                                 331/111
ggg cac cac gcc ttc ttc caa gct ggg tgg cct gtg gaa gac ggt ctc gcc gca tcg gtc
gly his his ala phe phe gln ala gly trp pro val glu asp gly leu ala ala ser val
361/121                                 391/131
gcc gat cag caa cat ggt gtc gat ggc caa caa cca cat gtc gat gac caa ctc ggg tgt
ala asp gln gln his gly val asp gly gln gln pro his val asp asp gln leu gly cys
421/141                                 451/151
gtc gat gac caa cac ctt gag ctc gat gtt gaa ggg ctt tgc tcc ggc ggc ggc cgc cca
val asp asp gln his leu glu leu asp val glu gly leu cys ser gly gly gly arg pro
481/161                                 511/171
ggc cgt gca aac cgc ggc gca aaa cgg ggt ccg ggc gat gag ctc gct ggg cag ctc gct
gly arg ala asn arg gly ala lys arg gly pro gly asp glu leu ala gly gln leu ala
541/181                                 571/191
ggg ttc ttc ggg tct ggg cgg tgg ggt ggc cgc caa ctt ggg tcg ggc ggc ctc ggt cgg
gly phe phe gly ser gly arg trp gly gly arg gln leu gly ser gly gly leu gly arg
601/201                                 631/211
ttc gtt gtc ggt gcc gca ggc ctg ggc cgc ggc caa cca ggc agt cac ccc ggc ggc gcg
phe val val gly ala ala gly leu gly arg gly gln pro gly ser his pro gly gly ala
661/221                                 691/231
ggc gct gcc gct gac cag cct gac cag cgc cgc gga aag agg gcc cgg gca gat gct ggg
gly ala ala ala asp gln pro asp gln arg arg gly lys arg ala arg ala asp ala gly
721/241                                 751/251
cgg gct gcc ggt ggg gca gat ggg cgc cag ggc cgg tgg tgg gct cag tgg tgt gct gcg
arg ala ala gly gly ala asp gly arg gln gly arg trp trp ala gln trp cys ala ala
781/261                                 811/271
tgt tcc gcc gcg acc cta tgt gat gcc gca ttc tcc ggc ggc cgg cta gga gag ggg gcg
cys ser ala ala thr leu cys asp ala ala phe ser gly gly arg leu gly glu gly ala
841/281
cag act gtc gtt att tga
gln thr val val ile)OPA
```

SEQ ID NOS:104-105

FIG. 5D' sequence Rv1196 predicted by Cole et al. (Nature 393:537-544) and capable of encoding an ORF fused with Seq5A'

```
1/1    SEQ ID NO: 106                       31/11
atg gtg gat ttc ggg gcg tta cca ccg gag atc aac tcc gcg agg atg tac gcc ggc ccg
Met val asp phe gly ala leu pro pro glu ile asn ser ala arg met tyr ala gly pro
61/21   SEQ ID NO: 107                      91/31
ggt tcg gcc tcg ctg gtg gcc gcg gct cag atg tgg gac agc gtg gcg agt gac ctg ttt
gly ser ala ser leu val ala ala ala gln met trp asp ser val ala ser asp leu phe
121/41                                      151/51
tcg gcc gcg tcg gcg ttt cag tcg gtg gtc tgg ggt ctg acg gtg ggg tcg tgg ata ggt
ser ala ala ser ala phe gln ser val val trp gly leu thr val gly ser trp ile gly
181/61                                      211/71
tcg tcg gcg ggt ctg atg gtg gcg gcg gcc tcg ccg tat gtg gcg tgg atg agc gtc acc
ser ser ala gly leu met val ala ala ala ser pro tyr val ala trp met ser val thr
241/81                                      271/91
gcg ggg cag gcc gag ctg acc gcc gcc cag gtc cgg gtt gct gcg gcg gcc tac gag acg
ala gly gln ala glu leu thr ala ala gln val arg val ala ala ala ala tyr glu thr
301/101                                     331/111
gcg tat ggg ctg acg gtg ccc ccg ccg gtg atc gcc gag aac cgt gct gaa ctg atg att
ala tyr gly leu thr val pro pro pro val ile ala glu asn arg ala glu leu met ile
361/121                                     391/131
ctg ata gcg acc aac ctc ttg ggg caa aac acc ccg gcg atc gcg gtc aac gag gcc gaa
leu ile ala thr asn leu leu gly gln asn thr pro ala ile ala val asn glu ala glu
421/141                                     451/151
tac ggc gag atg tgg gcc caa gac gcc gcc gcg atg ttt ggc tac gcc gcg gcg acg gcg
tyr gly glu met trp ala gln asp ala ala ala met phe gly tyr ala ala ala thr ala
481/161                                     511/171
acg gcg acg gcg acg ttg ctg ccg ttc gag gag gcg ccg gag atg acc agc gcg ggt ggg
thr ala thr ala thr leu leu pro phe glu glu ala pro glu met thr ser ala gly gly
541/181                                     571/191
ctc ctc gag cag gcc gcc gcg gtc gag gag gcc tcc gac acc gcc gcg gcg aac cag ttg
leu leu glu gln ala ala ala val glu glu ala ser asp thr ala ala ala asn gln leu
601/201                                     631/211
atg aac aat gtg ccc cag gcg ctg caa cag ctg gcc cag ccc acg cag ggc acc acg cct
met asn asn val pro gln ala leu gln gln leu ala gln pro thr gln gly thr thr pro
661/221                                     691/231
tct tcc aag ctg ggt ggc ctg tgg aag acg gtc tcg ccg cat cgg tcg ccg atc agc aac
ser ser lys leu gly gly leu trp lys thr val ser pro his arg ser pro ile ser asn
721/241                                     751/251
atg gtg tcg atg gcc aac aac cac atg tcg atg acc aac tcg ggt gtg tcg atg acc aac
met val ser met ala asn asn his met ser met thr asn ser gly val ser met thr asn
781/261                                     811/271
acc ttg agc tcg atg ttg aag ggc ttt gct ccg gcg gcg gcc gcc cag gcc gtg caa acc
thr leu ser ser met leu lys gly phe ala pro ala ala ala ala gln ala val gln thr
841/281                                     871/291
gcg gcg caa aac ggg gtc cgg gcg atg agc tcg ctg ggc agc tcg ctg ggt tct tcg ggt
ala ala gln asn gly val arg ala met ser ser leu gly ser ser leu gly ser ser gly
901/301                                     931/311
ctg ggc ggt ggg gtg gcc gcc aac ttg ggt cgg gcg gcc tcg gtc ggt tcg ttg tcg gtg
leu gly gly gly val ala ala asn leu gly arg ala ala ser val gly ser leu ser val
961/321                                     991/331
ccg cag gcc tgg gcc gcg gcc aac cag gca gtc acc ccg gcg gcg cgg gcg ctg ccg ctg
pro gln ala trp ala ala ala asn gln ala val thr pro ala ala arg ala leu pro leu
1021/341                                    1051/351
acc agc ctg acc agc gcc gcg gaa aga ggg ccc ggg cag atg ctg ggc ggg ctg ccg gtg
thr ser leu thr ser ala ala glu arg gly pro gly gln met leu gly gly leu pro val
1081/361                                    1111/371
ggg cag atg ggc gcc agg gcc ggt ggt ggg ctc agt ggt gtg ctg cgt gtt ccg ccg cga
gly gln met gly ala arg ala gly gly gly leu ser gly val leu arg val pro pro arg
1141/381                                    1171/391
ccc tat gtg atg ccg cat tct ccg gcg gcc ggc tag
pro tyr val met pro his ser pro ala ala gly)AMB
```

SEQ ID NOS:106-107

FIG. 5E'

Seq 5P: ORF according to Cole et al. (Nature 393:537-544) and containing the sequence Rv1196

```
1/1 ── SEQ ID NO: 108                    31/11
tag gga cac gta atg gtg gat ttc ggg gcg tta cca ccg gag atc aac tcc gcg agg atg
AMB(gly his val met val asp phe gly ala leu pro pro glu ile asn ser ala arg met
61/21 ── SEQ ID NO: 109                  91/31
tac gcc ggc ccg ggt tcg gcc tcg ctg gtg gcc gcg gct cag atg tgg gac agc gtg gcg
tyr ala gly pro gly ser ala ser leu val ala ala ala gln met trp asp ser val ala
121/41                                   151/51
agt gac ctg ttt tcg gcc gcg tcg gcg ttt cag tcg gtg gtc tgg ggt ctg acg gtg ggg
ser asp leu phe ser ala ala ser ala phe gln ser val val trp gly leu thr val gly
181/61                                   211/71
tcg tgg ata ggt tcg tcg gcg ggt ctg atg gtg gcg gcg gcc tcg ccg tat gtg gcg tgg
ser trp ile gly ser ser ala gly leu met val ala ala ala ser pro tyr val ala trp
241/81                                   271/91
atg agc gtc acc gcg ggg cag gcc gag ctg acc gcc gcc cag gtc cgg gtt gct gcg gcg
met ser val thr ala gly gln ala glu leu thr ala ala gln val arg val ala ala ala
301/101                                  331/111
gcc tac gag acg gcg tat ggg ctg acg gtg ccc ccg ccg gtg atc gcc gag aac cgt gct
ala tyr glu thr ala tyr gly leu thr val pro pro pro val ile ala glu asn arg ala
361/121                                  391/131
gaa ctg atg att ctg ata gcg acc aac ctc ttg ggg caa aac acc ccg gcg atc gcg gtc
glu leu met ile leu ile ala thr asn leu leu gly gln asn thr pro ala ile ala val
421/141                                  451/151
aac gag gcc gaa tac ggc gag atg tgg gcc caa gac gcc gcc gcg atg ttt ggc tac gcc
asn glu ala glu tyr gly glu met trp ala gln asp ala ala ala met phe gly tyr ala
481/161                                  511/171
gcg gcg acg gcg acg gcg acg gcg acg ttg ctg ccg ttc gag gag gcg ccg gag atg acc
ala ala thr ala thr ala thr ala thr leu leu pro phe glu glu ala pro glu met thr
541/181                                  571/191
agc gcg ggt ggg ctc ctc gag cag gcc gcc gcg gtc gag gag gcc tcc gac acc gcc gcg
ser ala gly gly leu leu glu gln ala ala ala val glu glu ala ser asp thr ala ala
601/201                                  631/211
gcg aac cag ttg atg aac aat gtg ccc cag gcg ctg caa cag ctg gcc cag ccc acg cag
ala asn gln leu met asn asn val pro gln ala leu gln gln leu ala gln pro thr gln
661/221                                  691/231
ggc acc acg cct tct tcc aag ctg ggt ggc ctg tgg aag acg gtc tcg ccg cat cgg tcg
gly thr thr pro ser ser lys leu gly gly leu trp lys thr val ser pro his arg ser
721/241                                  751/251
ccg atc agc aac atg gtg tcg atg gcc aac aac cac atg tcg atg acc aac tcg ggt gtg
pro ile ser asn met val ser met ala asn asn his met ser met thr asn ser gly val
781/261                                  811/271
tcg atg acc aac acc ttg agc tcg atg ttg aag ggc ttt gct ccg gcg gcg gcc gcc cag
ser met thr asn thr leu ser ser met leu lys gly phe ala pro ala ala ala ala gln
841/281                                  871/291
gcc gtg caa acc gcg gcg caa aac ggg gtc cgg gcg atg agc tcg ctg ggc agc tcg ctg
ala val gln thr ala ala gln asn gly val arg ala met ser ser leu gly ser ser leu
901/301                                  931/311
ggt tct tcg ggt ctg ggc ggt ggg gtg gcc gcc aac ttg ggt cgg gcg gcc tcg gtc ggt
gly ser ser gly leu gly gly gly val ala ala asn leu gly arg ala ala ser val gly
961/321                                  991/331
tcg ttg tcg gtg ccg cag gcc tgg gcc gcg gcc aac cag gca gtc acc ccg gcg gcg cgg
ser leu ser val pro gln ala trp ala ala ala asn gln ala val thr pro ala ala arg
1021/341                                 1051/351
gcg ctg ccg ctg acc agc ctg acc agc gcc gcg gaa aga ggg ccc ggg cag atg ctg ggc
ala leu pro leu thr ser leu thr ser ala ala glu arg gly pro gly gln met leu gly
1081/361 1111/371
ggg ctg ccg gtg ggg cag atg ggc gcc agg gcc ggt ggt ggg ctc agt ggt gtg ctg cgt
gly leu pro val gly gln met gly ala arg ala gly gly gly leu ser gly val leu arg
1141/381                                 1171/391
gtt ccg ccg cga ccc tat gtg atg ccg cat tct ccg gcg gcc ggc tag
val pro pro arg pro tyr val met pro his ser pro ala ala gly)AMB
```

SEQ ID NOS:108-109

FIG. 5F'

```
    SEQ ID NO: 110                              31/11
GGA TCC TGA TGC AAG TGG TCC GGG ATT TGT CGG CAG CCA CCG CGG TCC CGT CGA CCA ACG
gly ser OPA(cys lys trp ser gly ile cys arg gln pro arg arg ser arg arg pro thr
61/21         SEQ ID NO:  111                   91/31
TTG GTG CAT CCG GGC TGC GAG CAT GCA CGC ACC GAC CAG CGC GGC GAG CGC GGC TAG CTG
leu val his pro gly cys glu his ala arg thr asp gln arg gly glu arg gly)AMB(leu
121/41                                          151/51           SEQ ID NO:  112
CTT GCC CAC TGT TCC TCC CTG CCG GCA CCA TGT GCG ACA AGC TTA AGC GCA GCA GTA CCG
leu ala his cys ser ser leu pro ala pro cys ala thr ser leu ser ala ala val pro
181/61                                          211/71
GCG GTG CCT GGG CAT CCA GCA AAA CGG GGA GCT CAA GAA CGA TTC ATG AAC GAG GGG TCG
ala val pro gly his pro ala lys arg gly ala gln glu arg phe met asn glu gly sec
241/81                                          271/91
TCA CCA ACG TCG AAA CCG ACG GTT GCC AGC CGG CCC ACG ATA TTG CGT GCT CGA GGG TCC
ser pro thr ser lys pro thr val ala ser arg pro thr ile leu arg ala arg gly ser
301/101                                         331/111
GCT GTA CCC TCA CCG AAC GTG AGT CCC ACA CCG CGG AGG CGG GCG ACT CTG GCG TCG TTA
ala val pro ser pro asn val ser pro thr pro arg arg arg ala thr leu ala ser leu
361/121                                         391/131
GCA GCC GAG CTC AAG GTG TCC CGC ACC ACT GTC TCG AAT GCT TTT AAC CGA CCG GAT CCA
ala ala glu leu lys val ser arg thr thr val ser asn ala phe asn arg pro asp pro
421/141
GAA GGA GAA GAT C
glu gly glu asp)

SEQ ID NOS:110-112

FIG. 6A

SEQ ID NO: 113                              32/11
GAT CCT GAT GCA AGT GGT CCG GGA TTT GTC GGC AGC CAC GGC GGT CCC GTC GAC CAA CGT
(asp pro asp ala ser gly pro gly phe val gly ser his gly gly pro val asp gln arg
62/21       SEQ ID NO:  114                     92/31
TGG TGC ATC CGG GCT GCG AGC ATG CAC GCA CCG ACC AGC GCG GCG AGC GCG GCT AGC TGC
trp cys ile arg ala ala ser met his ala pro thr ser ala ala ser ala ala ser cys
122/41                                          152/51
TTG CCC ACT GTT CCT CCC TGC GGC ACC ATG TGC GAC AAG CTA AGC GCA GCA GTA CGG
leu pro thr val pro pro cys arg his his val arg gln ala)OCH(ala gln gln tyr arg
182/61                                          212/71           SEQ ID NO:  115
CGG TGC CTG GGC ATC CAG CAA AAC GGG GAG CTC AAG AAC GAT TCA TGA ACG AGG GTC GT
arg cys leu gly ile gln gln asn gly glu leu lys asn asp ser)OPA(thr arg gly arg
242/81                                          272/91 SEQ ID NO:  116
CAC CAA CGT CGA AAC CGA CGG TTG CCA GCC GGC CCA CGA TAT GCG TGC TCG AGG GTC CG
his gln arg arg asn arg arg leu pro ala gly pro arg tyr cys val leu glu gly pro
302/101                                         332/111
CTG TAC CCT CAC CGA ACG TGA GTC CCA CAC CGC GGA GGC GGG CGA CTC TGG CGT CGT TAG
leu tyr pro his arg thr)OPA(val pro his arg gly gly gly arg leu trp arg arg)AMB
362/121     SEQ ID NO:  117                     392/131
CAG CCG AGC TCA AGG TGT CCC GCA CCA CTG TCT CGA ATG CTT TTA ACC GAC CGG ATC AG
(gln pro ser ser arg cys pro ala pro leu ser arg met leu leu thr asp arg ile gln
422/141     SEQ ID NO:  118
AAG GAG AAG ATC
lys glu lys ile)

SEQ ID NOS:113-118

FIG. 6B
```

```
             SEQ ID NO: 119                        33/11
ATC CTG ATG CAA GTG GTC CGG GAT TTG TCG GCA GCC ACG GCG GTC CCG TCG ACC AAC GTT
(ile leu met gln val val arg asp leu ser ala ala thr ala val pro ser thr asn val
63/21        SEQ ID NO: 120                       93/31
GGT GCA TCC GGG CTG CGA GCA TGC ACG CAC CGA CCA GCG CGG CGA GCG CGG CTA GCT GCT
gly ala ser gly leu arg ala cys thr his arg pro ala arg arg ala arg leu ala ala
123/41                                            153/51
TGC CCA CTG TTC CTC CCT GCC GGC ACC ATG TGC GAC AAG CTT AAG CGC AGC AGT ACC GGC
cys pro leu phe leu pro ala gly thr met cys asp lys leu lys arg ser ser thr gly
183/61                                            213/71
GGT GCC TGG GCA TCC AGC AAA ACG GGG AGC TCA AGA ACG ATT CAT GAA CGA GGG GTC GTC
gly ala trp ala ser ser lys thr gly ser ser arg thr ile his glu arg gly val val
243/81                                            273/91
ACC AAC GTC GAA ACC GAC GGT TGC CAG CCG GCC CAC GAT ATT GCG TGC TCG AGG GTC CGC
thr asn val glu thr asp gly cys gln pro ala his asp ile ala cys ser arg val arg
303/101                                           333/111
TGT ACC CTC ACC GAA CGT GAG TCC CAC ACC GCG GAG GCG GGC GAC TCT GGC GTC GTT AGC
cys thr leu thr glu arg glu ser his thr ala glu ala gly asp ser gly val val ser
363/121                                           393/131
AGC CGA GCT CAA GGT GTC CCG CAC CAC TGT CTC GAA TGC TTT TAA CCG ACC GGA TCC AGA
ser arg ala gln gly val pro his his cys leu glu cys phe)OCH(pro thr gly ser arg
423/141                                     SEQ ID NO: 121
AGG AGA AGA TC
arg arg arg)
```

SEQ ID NOS:119-121

FIG. 6C

```
             SEQ ID NO: 122                        31/11
CCG TCG GCA ACT TGG CCG CTG AGG TCG GCT TGA TCC CTG GGC CGA GGC GGG TCA GCC AAT
(pro ser ala thr trp pro leu arg ser ala)OPA(ser leu gly arg gly gly ser ala asn
61/21        SEQ ID NO: 123                       91/31       SEQ ID NO: 124
AGC GGC TCC ATC GGC TTT GCT GGT AGC GGT TCG GCG GGA AGC TAG CGG CGA CGT TGT CGG
ser gly ser ile gly phe ala gly ser gly ser ala gly ser)AMB(arg arg arg cys arg
121/41                                            151/51             SEQ ID NO: 125
TGG CCG GTG ATA TAT TCG GTC AGA CGG GTA TGG CGG CGG CTG AGG TGA TCT GCG ACA CGC
trp pro val ile tyr trp val arg arg val trp arg arg leu arg)OPA(ser ala thr arg
181/61                                            211/71  SEQ ID NO: 126
CGC CGC GGT GCT CGA GCC AGG CTT ACG ACC AGG GAA TTT CGA AAA TGT TAT TCA GAA CAT
arg arg gly ala arg ala arg leu thr thr arg glu phe arg lys cys tyr ser glu his
241/81                                            271/91
CTT GTA TCT CTT CTC CGT GCC ACC CCC TAG GTG TAG TGT TTT CGA GTA CCG GCA GAT CCC
leu val ser leu leu arg ala thr pro)AMB val AMB(cys phe arg val pro ala asp pro
301/101                                         SEQ ID NO: 127
AGG TTC ACC AGG TCT CAC CAG ATC
arg phe thr arg ser his gln ile)
```

SEQ ID NOS:122-127

FIG. 7A

```
                    SEQ ID NO: 128                          32/11
CGT CGG CAA CTT GGC CGC TGA GGT CGG CTT GAT CCC TGG GCC GAG GCG GGT CAG CCA ATA
(arg arg gln leu gly arg)OPA(gly arg leu asp pro trp ala glu ala gly gln pro ile
 62/21  SEQ ID NO: 129                        92/31  SEQ ID NO: 130
GCG GCT CCA TCG GCT TTG CTG GTA GCG GTT CGG CGG GAA GCT AGC GGC GAC GTT GTC GGT
ala ala pro ser ala leu leu val ala val arg arg glu ala ser gly asp val val gly
122/41                                        152/51
GGC CGG TGA TAT ATT GGG TCA GAC GGG TAT GGC GGC GGC TGA GGT GAT CTG CGA CAC GCC
gly arg)OPA(tyr ile gly ser asp gly tyr gly gly gly)OPA(gly asp leu arg his ala
182/61        SEQ ID NO: 131                  212/71          SEQ ID NO: 132
GCC GCG GTG CTC GAG CCA GGC TTA CGA CCA GGG AAT TTC GAA AAT GTT ATT CAG AAC ATC
ala ala val leu glu pro gly leu arg pro gly asn phe glu asn val ile gln asn ile
242/81                                        272/91
TTG TAT CTC TTC TCC GTG CCA CCC CCT AGG TGT AGT GTT TTC GAG TAC CGG CAG ATC CCA
leu tyr leu phe ser val pro pro pro arg cys ser val phe glu tyr arg gln ile pro
302/101
GGT TCA CCA GGT CTC ACC AGA TC
gly ser pro gly leu thr arg)
```

SEQ ID NOS:128-132

FIG. 7B

```
      SEQ ID NO: 133                          33/11
GTC GGC AAC TTG GCC GCT GAG GTC GGC TTG ATC CCT GGG CCG AGG CGG GTC AGC AAT AG
(val gly asn leu ala ala glu val gly leu ile pro gly pro arg arg val ser gln)AMB
 63/21  SEQ ID NO: 134                         93/31
CGG CTC CAT CGG CTT TGC TGG TAG CGG TTC GGC GGG AAG CTA GCG GCG ACG TTG TCG GTG
(arg leu his arg leu cys trp)AMB(arg phe gly gly lys leu ala ala thr leu ser val
123/41   SEQ ID NO: 135                       153/51   SEQ ID NO: 136
GCC GGT GAT ATA TTG GGT CAG ACG GGT ATG GCG GCG GCT GAG GTG ATC TGC GAC ACG CCG
ala gly asp ile leu gly gln thr gly met ala ala ala glu val ile cys asp thr pro
183/61                                        213/71
CCG CGG TGC TCG AGC CAG GCT TAC GAC CAG GGA ATT TCG AAA ATG TTA TTC AGA ACA TCT
pro arg cys ser ser gln ala tyr asp gln gly ile ser lys met leu phe arg thr ser
243/81                                        273/91
TGT ATC TCT TCT CCG TGC CAC CCC CTA GGT GTA GTG TTT TCG AGT ACC GGC AGA TCC AG
cys ile ser ser pro cys his pro leu gly val val phe ser ser thr gly arg ser gln
303/101
GTT CAC CAG GTC TCA CCA GAT C
val his gln val ser pro asp)
```

SEQ ID NOS:133-136

FIG. 7C

```
                SEQ ID NO: 137                          31/11
         CTT TGC GTG ATG TCC AAT GGC GAA AAC GAC GCC TTG TCA TCG CAA TCG TCA GCA CCG GCC
         (leu cys val met ser asn gly glu asn asp ala leu ser ser gln ser ser ala pro ala)
         61/21       SEQ ID NO: 138                     91/31
         TAG TTT TCG CGA TGA CGC TCG TTC TGA CCG GAC TTG TGA ACG GGT TTC GGG TCG AGG CCG
         AMB phe ser arg OPA arg ser phe OPA pro asp leu OPA thr gly phe gly ser arg pro
         121/41                                151/51         SEQ ID NO: 272
         AGC GAA CCG TCG ATT CCA TGG GTG TCG ACG CAT TCG TGG TCA AGG CCG GCG CGG CAG GAC
         ser glu pro ser ile pro trp val ser thr his ser trp ser arg pro ala arg gln asp
         181/61                                211/71
         CGT TCC TGG GTT CGA CAC CAT TCG CCC AAA TCG ACC TGC CCC AGG TTG CTC GTG CGC CTG
         arg ser trp val arg his his ser pro lys ser thr cys pro arg leu leu val arg leu
         241/81                                271/91
         GCG TCT TGG CTG CCG CCC CAC TAG CGA CTG CGC CGT CGA CGA TCC GGC AGG GCA CGT CAG
         ala ser trp leu pro pro his)AMB(arg leu arg arg arg arg ser gly arg ala arg gln
         301/101     SEQ ID NO: 273               331/111
         CGC GAA ACG TCA CCG CGT TCG GGG CAC CAG AGC ACG GAC CCG GCA TGC CGC GGG TCT CGG
         arg glu thr ser pro arg ser gly his gln ser thr asp pro ala cys arg gly ser arg
         361/121                               391/131
         ACG GTC GGG CGC CAT CGA CGC CGG ACG AGG TCG CGG TGT CGA GCA CGC TGG GCC GAA ACC
         thr val gly arg his arg arg arg thr arg ser arg cys arg ala arg trp ala glu thr
         421/141
         TCG GCG ACG ATC
         ser ala thr ile)

SEQ ID NOS:137-138,272-273

FIG. 8A

SEQ ID NO: 139                          32/11
         TTT GCG TGA TGT CCA ATG GCG AAA ACG ACG CCT TGT CAT CGC AAT CGT CAG CAC CGG CCT
         phe ala OPA(cys pro met ala lys thr thr pro cys his arg asn arg gln his arg pro
         62/21        SEQ ID NO: 140             92/31
         AGT TTT CGC GAT GAC GCT CGT TCT GAC CGG ACT TGT GAA CGG GTT TCG GGT CGA GGC CGA
         ser phe arg asp asp ala arg ser asp arg thr cys glu arg val ser gly arg gly arg
         122/41                                152/51
         GCG AAC CGT CGA TTC CAT GGG TGT CGA CGC ATT CGT GGT CAA GGC CGG CGC GGC AGG ACC
         ala asn arg arg phe his gly cys arg arg ile arg gly gln gly arg arg gly arg thr
         182/61                                212/71
         GTT CCT GGG TTC GAC ACC ATT CGC CCA AAT CGA CCT GCC CCA GGT TGC TCG TGC GCC TGG
         val pro gly phe asp thr ile arg pro asn arg pro ala pro gly cys ser cys ala trp
         242/81                                272/91
         CGT CTT GGC TGC CGC CCC ACT AGC GAC TGC GCC GTC GAC GAT CCG GCA GGG CAC GTC AGC
         arg leu gly cys arg pro thr ser asp cys ala val asp asp pro ala gly his val ser
         302/101                               332/111
         GCG AAA CGT CAC CGC GTT CGG GGC ACC AGA GCA CGG ACC GGC ATG CCG CGG GTC TCG GA
         ala lys arg his arg val arg gly thr arg ala arg thr arg his ala ala gly leu gly
         362/121                               392/131
         CGG TCG GGC GCC ATC GAC GCC GGA CGA GGT CGC GGT GTC GAG CAC GCT GGG CCG AAA CCT
         arg ser gly ala ile asp ala gly arg gly arg gly val glu his ala gly pro lys pro
         422/141
         CGG CGA CGA TC
         arg arg arg)

SEQ ID NOS:139-140

FIG. 8B
```

```
         SEQ ID NO: 141                              33/11
        TTG CGT GAT GTC CAA TGG CGA AAA CGA CGC CTT GTC ATC GCA ATC GTC AGC ACC GGC CTA
        (leu arg asp val gln trp arg lys arg arg leu val ile ala ile val ser thr gly leu
         63/21       SEQ ID NO:  142                93/31
         GTT TTC GCG ATG ACG CTC GTT CTG ACC GGA CTT GTG AAC GGG TTT CGG GTC GAG GCC GAG
         val phe ala met thr leu val leu thr gly leu val asn gly phe arg val glu ala glu
         123/41                                      153/51
         CGA ACC GTC GAT TCC ATG GGT GTC GAC GCA TTC GTG GTC AAG GCC GGC GCA GGA CCG
         arg thr val asp ser met gly val asp ala phe val val lys ala gly ala ala gly pro
         183/61                                      213/71
         TTC CTG GGT TCG ACA CCA TTC GCC CAA ATC GAC CTG CCC CAG GTT GCT CGT GCG CCT GGC
         phe leu gly ser thr pro phe ala gln ile asp leu pro gln val ala arg ala pro gly
         243/81                                      273/91
         GTC TTG GCT GCC GCC CCA CTA GCG ACT GCG CCG TCG ACG ATC GGC AGG GCC ACG TCA GCG
         val leu ala ala ala pro leu ala thr ala pro ser thr ile arg gln gly thr ser ala
         303/101                                     333/111
         CGA AAC GTC ACC GCG TTC GGG GCA CCA GAG CAC GGA CCC GGC ATG CCG CGG GTC TCG GAC
         arg asn val thr ala phe gly ala pro glu his gly pro gly met pro arg val ser asp
         363/121                                     393/131
         GGT CGG GCG CCA TCG ACG CCG GAC GAG GTC GCG GTG TCG AGC ACG CTG GGC CGA AAC CTC
         gly arg ala pro ser thr pro asp glu val ala val ser ser thr leu gly arg asn leu
         423/141
         GGC GAC GAT C
         gly asp asp)
```

SEQ ID NOS:141-142

FIG. 8C part of the nucleotide sequence of seq8A

```
         1/1    SEQ ID NO:  143                      31/11
        CAG GTT GCT CGT GCG CCT GGC GTC TTG GCT GCC GCC CCA CTA GCG ACT GCG CCG TCG ACG
        (gln val ala arg ala pro gly val leu ala ala ala pro leu ala thr ala pro ser thr
         61/21       SEQ ID NO: 144                  91/31
         ATC CGG CAG GGC ACG TCA GCG CGA AAC GTC ACC GCG TTC GGG GCA CCA GAG CAC GGA CCC
         ile arg gln gly thr ser ala arg asn val thr ala phe gly ala pro glu his gly pro
         121/41                                      151/51
         GGC ATG CCG CGG GTC TCG GAC GGT CGG GCG CCA TCG ACG CCG GAC GAG GTC GCG GTG TCG
         gly met pro arg val ser asp gly arg ala pro ser thr pro asp glu val ala val ser
         181/61
         AGC ACG CTG GGC CGA AAC CTC GGC GAC GAT C
         ser thr leu gly arg asn leu gly asp asp)
```

SEQ ID NOS.143-144

FIG. 8A'

```
1/1   SEQ ID NO: 145                    31/11
AGG TTG CTC GTG CGC CTG GCG TCT TGG CTG CCG CCC CAC TAG CGA CTG CGC CGT CGA CGA
(arg leu leu val arg leu ala ser trp leu pro pro his)AMB(arg leu arg arg arg arg
61/21   SEQ ID NO: 146                  91/31         SEQ ID NO: 147
TCC GGC AGG GCA CGT CAG CGC GAA ACG TCA CCG CGT TCG GGG CAC CAG AGC ACG GAC CCG
ser gly arg ala arg gln arg glu thr ser pro arg ser gly his gln ser thr asp pro
121/41                                  151/51
GCA TGC CGC GGG TCT CGG ACG GTC GGG CGC CAT CGA CGC CGG ACG AGG TCG CGG TGT CGA
ala cys arg gly ser arg thr val gly arg his arg arg arg thr arg ser arg cys arg
181/61
GCA CGC TGG GCC GAA ACC TCG GCG ACG ATC
ala arg trp ala glu thr ser ala thr ile)
```

SEQ ID NOS:145-147

FIG. 8B'

Seq8C

```
1/1   SEQ ID NO: 148                    31/11
CCA GGT TGC TCG TGC GCC TGG CGT CTT GGC TGC CGC CCC ACT AGC GAC TGC GCC GTC GAC
(pro gly cys ser cys ala trp arg leu gly cys arg pro thr ser asp cys ala val asp
61/21   SEQ ID NO: 149                  91/31
GAT CCG GCA GGG CAC GTC AGC GCG AAA CGT CAC CGC GTT CGG GGC ACC AGA GCA CGG ACC
asp pro ala gly his val ser ala lys arg his arg val arg gly thr arg ala arg thr
121/41                                  151/51
CGG CAT GCC GCG GGT CTC GGA CGG TCG GGC GCC ATC GAC GCC GGA CGA GGT CGC GGT GTC
arg his ala ala gly leu gly arg ser gly ala ile asp ala gly arg gly arg gly val
181/61
GAG CAC GCT GGG CCG AAA CCT CGG CGA CGA TC
glu his ala gly pro lys pro arg arg arg)
```

SEQ ID NOS:148-149

FIG. 8C' sequence Rv2563 predicted by Cole et al. (Nature 393:537-544) and containing seq8A'

```
atg
met
121/41    SEQ ID NO: 150              151/51
ctt ttt gcg gct ttg cgt gat gtc caa tgg cga aaa cga cgc ctt gtc atc gca atc gtc
(leu phe ala ala leu arg asp val gln trp arg lys arg arg leu val ile ala ile val
181/61    SEQ ID NO: 151              211/71
agc acc ggc cta gtt ttc gcg atg acg ctc gtt ctg acc gga ctt gtg aac ggg ttt cgg
ser thr gly leu val phe ala met thr leu val leu thr gly leu val asn gly phe arg
241/81                                271/91
gtc gag gcc gag cga acc gtc gat tcc atg ggt gtc gac gca ttc gtg gtc aag gcc ggc
val glu ala glu arg thr val asp ser met gly val asp ala phe val val lys ala gly
301/101                               331/111
gcg gca gga ccg ttc ctg ggt tcg aca cca ttc gcc caa atc gac ctg ccc cag gtt gct
ala ala gly pro phe leu gly ser thr pro phe ala gln ile asp leu pro gln val ala
361/121                               391/131
cgt gcg cct ggc gtc ttg gct gcc gcc cca cta gcg act gcg ccg tcg acg atc cgg cag
arg ala pro gly val leu ala ala ala pro leu ala thr ala pro ser thr ile arg gln
421/141                               451/151
ggc acg tca gcg cga aac gtc acc gcg ttc ggg gca cca gag cac gga ccc ggc atg ccg
gly thr ser ala arg asn val thr ala phe gly ala pro glu his gly pro gly met pro
481/161                               511/171
cgg gtc tcg gac ggt cgg gcg cca tcg acg ccg gac gag gtc gcg gtg tcg agc acg ctg
arg val ser asp gly arg ala pro ser thr pro asp glu val ala val ser ser thr leu
541/181                               571/191
ggc cga aac ctc ggc gac gat ctg caa gtg ggt gcg cgc act ttg cgg atc gtc ggc atc
gly arg asn leu gly asp asp leu gln val gly ala arg thr leu arg ile val gly ile
601/201                               631/211
gtg ccc gag tca acc gcg ctg gca aag att ccc aac atc ttc ctg acc acc gaa ggc cta
val pro glu ser thr ala leu ala lys ile pro asn ile phe leu thr thr glu gly leu
661/221                               691/231
cag cag ttg gca tac aac gga cag ccg aca atc agt tcg atc ggg atc gac ggg atg ccc
gln gln leu ala tyr asn gly gln pro thr ile ser ser ile gly ile asp gly met pro
721/241                               751/251
cga cag ctc ccg gac ggc tat cag acc gtc aat cga gcg gat gct gtc agc gat ctg atg
arg gln leu pro asp gly tyr gln thr val asn arg ala asp ala val ser asp leu met
781/261                               811/271
cgc ccg ttg aag gtc gcg gtg gat gcg atc acg gtt gtg gcg gtc ttg ctg tgg atc gtt
arg pro leu lys val ala val asp ala ile thr val val ala val leu leu trp ile val
841/281                               871/291
gcg gcg ttg atc gtc ggc tcg gtg gtc tac ctc tct gcg ttg gag cgg ctg cgt gac ttt
ala ala leu ile val gly ser val val tyr leu ser ala leu glu arg leu arg asp phe
901/301                               931/311
gcg gtg ttc aag gcg atc ggc gtg ccg acg cgc tcg att ctg gcc ggg ctg gcg ctg cag
ala val phe lys ala ile gly val pro thr arg ser ile leu ala gly leu ala leu gln
961/321                               991/331
gcg gtc gtc gtc gcg ctc ctc gcg gcg gtg gtt ggc ggc atc ctt tcg ctg ctg ttg gcg
ala val val val ala leu leu ala ala val val gly gly ile leu ser leu leu leu ala
1021/341                              1051/351
ccg ttg ttc ccg atg act gtc gtg gta ccc ctg agt gcc ttc gtg gcg cta ccg gcg atc
pro leu phe pro met thr val val val pro leu ser ala phe val ala leu pro ala ile
1081/361                              1111/371
gcg act gtg atc ggt ctg ctg gcc agc gtc gca gga ctg cgg cgc gtg gtg gcg atc gat
ala thr val ile gly leu leu ala ser val ala gly leu arg arg val val ala ile asp
1141/381
ccg gca cta gcg ttc gga ggt ccc tag
pro ala leu ala phe gly gly pro)AMB
```

SEQ ID NOS:150-151

FIG. 8D

ORF predicted by Cole et al. (Nature 393:537-544) and containing Rv2563

1/1 SEQ ID NO: 152                          31/11
tag gtt tca aga agg cct gtg cag gtt tcc gca gcc tgg gcc gcg gcg cca ccg aag agc
AMB(val ser arg arg pro val gln val ser ala ala trp ala ala ala pro pro lys ser
61/21 SEQ ID NO: 153                        91/31
ccg ccg aaa tgg gct aat cgg gtt cgc ttg gct cga tcg ccg atg atc tcg acc gcc acg
pro pro lys trp ala asn arg val arg leu ala arg ser pro met ile ser thr ala thr
121/41                                      151/51
acc gac ccc ctc acc tcg gtc gaa cct cgg cga acc aac gcg gca acg cca gcc cat gat
thr asp pro leu thr ser val glu pro arg arg thr asn ala ala thr pro ala his asp
181/61                                      211/71
cat ttg att ggg tcc acg gaa gca ggt agc ttc cgt cgc atg ctt ttt gcg gct ttg cgt
his leu ile gly ser thr glu ala gly ser phe arg arg met leu phe ala ala leu arg
241/81                                      271/91
gat gtc caa tgg cga aaa cga cgc ctt gtc atc gtc agc acc ggc cta gtt ttc
asp val gln trp arg lys arg arg leu val ile ala ile val ser thr gly leu val phe
301/101                                     331/111
gcg atg acg ctc gtt ctg acc gga ctt gtg aac ggg ttt cgg gtc gag gcc gag cga acc
ala met thr leu val leu thr gly leu val asn gly phe arg val glu ala glu arg thr
361/121                                     391/131
gtc gat tcc atg ggt gtc gac gca ttc gtg gtc aag gcc ggc gcg gca gga ccg ttc ctg
val asp ser met gly val asp ala phe val val lys ala gly ala ala gly pro phe leu
421/141                                     451/151
ggt tcg aca cca ttc gcc caa atc gac ctg ccc cag gtt gct cgt gcg cct ggc gtc ttg
gly ser thr pro phe ala gln ile asp leu pro gln val ala arg ala pro gly val leu
481/161                                     511/171
gct gcc gcc cca cta gcg act gcg ccg tcg acg atc gga cag ggc acg tca gcg cga aac
ala ala ala pro leu ala thr ala pro ser thr ile arg gln gly thr ser ala arg asn
541/181                                     571/191
gtc acc gcg ttc ggg gca cca gag cac gga ccc ggc atg ccg cgg gtc tcg gac ggt cgg
val thr ala phe gly ala pro glu his gly pro gly met pro arg val ser asp gly arg
601/201                                     631/211
gcg cca tcg acg ccg gac gag gtc gcg gtg tcg agc acg ctg ggc cga aac ctc ggc gac
ala pro ser thr pro asp glu val ala val ser ser thr leu gly arg asn leu gly asp
661/221                                     691/231
gat ctg caa gtg ggt gcg cgc act ttg cgg atc gtc ggc atc gtg ccc gag tca acc gcg
asp leu gln val gly ala arg thr leu arg ile val gly ile val pro glu ser thr ala
721/241                                     751/251
ctg gca aag att ccc aac atc ttc ctg acc acc gaa ggc cta cag cag ttg gca tac aac
leu ala lys ile pro asn ile phe leu thr thr glu gly leu gln gln leu ala tyr asn
781/261                                     811/271
gga cag ccg aca atc agt tcg atc ggg atc gac ggg atg ccc cga cag ctc ccg gac ggc
gly gln pro thr ile ser ser ile gly ile asp gly met pro arg gln leu pro asp gly
841/281                                     871/291
tat cag acc gtc aat cga gcg gat gct gtc agc gat ctg atg cgc ccg ttg aag gtc gcg
tyr gln thr val asn arg ala asp ala val ser asp leu met arg pro leu lys val ala
901/301                                     931/311
gtg gat gcg atc acg gtt gtg gcg gtc ttg ctg tgg atc gtt gcg gcg ttg atc gtc ggc
val asp ala ile thr val val ala val leu leu trp ile val ala ala leu ile val gly
961/321                                     991/331
tcg gtg gtc tac ctc tct gcg ttg gag cgg ctg cgt gac ttt gcg gtg ttc aag gcg atc
ser val val tyr leu ser ala leu glu arg leu arg asp phe ala val phe lys ala ile
1021/341                                    1051/351
ggc gtg ccg acg cgc tcg att ctg gcc ggg ctg gcg ctg cag gcg gtc gtc gtc gcg ctg
gly val pro thr arg ser ile leu ala gly leu ala leu gln ala val val val ala leu
1081/361                                    1111/371
ctc gcg gcg gtg gtt ggc ggc atc ctt tcg ctg ctg ttg gcg ccg ttc ccg atg act
leu ala ala val val gly gly ile leu ser leu leu leu ala pro leu phe pro met thr
1141/381                                    1171/391
gtc gtg gta ccc ctg agt gcc ttc gtg gcg cta ccg gcg atc gcg act gtg atc ggt ctg
val val val pro leu ser ala phe val ala leu pro ala ile ala thr val ile gly leu
1201/401                                    1231/411
ctg gcc agc gtc gca gga ctg cgg cgc gtg gtg gcg atc gat ccg gca cta gcg ttc gga
leu ala ser val ala gly leu arg arg val val ala ile asp pro ala leu ala phe gly
1261/421
ggt ccc tag
gly pro) AMB

SEQ ID NOS:152-153

FIG. 8E sequence of Rv0072 predicted by Cole et al. (Nature 393:537-544) and
exhibiting more than 77% similarity with Seq8D'

```
1/1      SEQ ID NO: 154                31/11
atg ctc ttc gcg gcc ctg cgt gac atg caa tgg aga aag cgc cgc ctg gtc atc acg atc
(Met leu phe ala ala leu arg asp met gln trp arg lys arg arg leu val ile thr ile
61/21    SEQ ID NO: 155                91/31
atc agc acc ggg ctg atc ttc ggg atg acg ctt gtt ttg acc gga ctc gcg aac ggc ttc
ile ser thr gly leu ile phe gly met thr leu val leu thr gly leu ala asn gly phe
121/41                                 151/51
cgg gtg gag gcc cgg cac acc gtc gat tcc atg ggt gtc gat gta ttc gtc gtc aga tcc
arg val glu ala arg his thr val asp ser met gly val asp val phe val val arg ser
181/61                                 211/71
ggc gct gct gga cct ttt ctg ggt tca ata ccg ttt ccc gat gtt gac ctg gcc cga gtg
gly ala ala gly pro phe leu gly ser ile pro phe pro asp val asp leu ala arg val
241/81                                 271/91
gcc gct gaa ccc ggt gtc atg gcc gcg gcc ccg ttg ggc agc gtg ggg acg atc atg aaa
ala ala glu pro gly val met ala ala ala pro leu gly ser val gly thr ile met lys
301/101                                331/111
gaa ggc acg tcg acg cga aac gtc acg gtc ttc ggc gcg ccc gag cac gga cct ggc atg
glu gly thr ser thr arg asn val thr val phe gly ala pro glu his gly pro gly met
361/121                                391/131
cca cgg gtc tca gag ggt cgg tca ccg tcg aaa ccg gac gaa gtc gcg gca tcg agc acg
pro arg val ser glu gly arg ser pro ser lys pro asp glu val ala ala ser ser thr
421/141                                451/151
atg ggc cga cac ctc ggt gac act gtc gag gtc ggc gcg cgc aga ttg cgg gtc gtt ggc
met gly arg his leu gly asp thr val glu val gly ala arg arg leu arg val val gly
481/161                                511/171
att gtg ccg aat tcc acc gcg ctg gcc aag atc ccc aat gtc ttc ctc acg acc gag ggc
ile val pro asn ser thr ala leu ala lys ile pro asn val phe leu thr thr glu gly
541/181                                571/191
tta cag aaa ttg gcg tac aac ggg cag ccg aat atc acg tcc atc ggg atc ata ggt atg
leu gln lys leu ala tyr asn gly gln pro asn ile thr ser ile gly ile ile gly met
601/201                                631/211
ccc cga cag ctg ccg gag ggt tac cag act ttc gat cgg gtg ggc gct gtc aat gat ttg
pro arg gln leu pro glu gly tyr gln thr phe asp arg val gly ala val asn asp leu
661/221                                691/231
gtg cgc cca ttg aag gtc gca gtg aat tcg atc tcg atc gtg gct gtt ttg ctg tgg att
val arg pro leu lys val ala val asn ser ile ser ile val ala val leu leu trp ile
721/241                                751/251
gtg gcg gtg ctg atc gtc ggc tcg gtg gtg tac ctt tcg gct ctt gag cgg cta cgt gac
val ala val leu ile val gly ser val val tyr leu ser ala leu glu arg leu arg asp
781/261                                811/271
ttc gcg gtg ttc aag gcg att ggc acg cca acg cgc tcg att atg gcc ggg ctc gca tta
phe ala val phe lys ala ile gly thr pro thr arg ser ile met ala gly leu ala leu
841/281                                871/291
cag gcg ctg gtc att gcg ttg ctt gcg gcg gtg gtg ggc gtc gtc ctg gcg cag gtg ttg
gln ala leu val ile ala leu leu ala ala val val gly val val leu ala gln val leu
901/301                                931/311
gca cca ctg ttt ccg atg att gtc gcg gta ccc gtc ggt gct tac ctg gcg cta ccg gtg
ala pro leu phe pro met ile val ala val pro val gly ala tyr leu ala leu pro val
961/321                                991/331
gcc gcg atc gtc atc ggt ctg ttc gct agt gtt gcc gga ttg aag cgc gtg gtg acg gtc
ala ala ile val ile gly leu phe ala ser val ala gly leu lys arg val val thr val
1021/341
gat ccc gcg cag gcg ttc gga ggt ccc tag
asp pro ala gln ala phe gly gly pro)AMB
```

SEQ ID NOS:154-155

FIG. 8F

Seq8H : ORF predicted by Cole et al. (Nature 393:537-544) and containing seq8G

1/1 — SEQ ID NO: 156  31/11
tag cct ctg gga atg ctc ttc gcg gcc ctg cgt gac atg caa tgg aga aag cgc cgc ctg
AMB(pro leu gly met leu phe ala ala leu arg asp met gln trp arg lys arg arg leu
61/21 — SEQ ID NO: 157  91/31
gtc atc acg atc atc agc acc ggg ctg atc ttc ggg atg acg ctt gtt ttg acc gga ctc
val ile thr ile ile ser thr gly leu ile phe gly met thr leu val leu thr gly leu
121/41  151/51
gcg aac ggc ttc cgg gtg gag gcc cgg cac acc gtc gat tcc atg ggt gtc gat gta ttc
ala asn gly phe arg val glu ala arg his thr val asp ser met gly val asp val phe
181/61  211/71
gtc gtc aga tcc ggc gct gct gga cct ttt ctg ggt tca ata ccg ttt ccc gat gtt gac
val val arg ser gly ala ala gly pro phe leu gly ser ile pro phe pro asp val asp
241/81  271/91
ctg gcc cga gtg gcc gct gaa ccc ggt gtc atg gcc gcg gcc ccg ttg ggc agc gtg ggg
leu ala arg val ala ala glu pro gly val met ala ala ala pro leu gly ser val gly
301/101  331/111
acg atc atg aaa gaa ggc acg tcg acg cga aac gtc acg gtc ttc ggc gcg ccc gag cac
thr ile met lys glu gly thr ser thr arg asn val thr val phe gly ala pro glu his
361/121  391/131
gga cct ggc atg cca cgg gtc tca gag ggt cgg tca ccg tcg aaa ccg gac gaa gtc gcg
gly pro gly met pro arg val ser glu gly arg ser pro ser lys pro asp glu val ala
421/141  451/151
gca tcg agc acg atg ggc cga cac ctc ggt gac act gtc gag gtc ggc gcg cgc aga ttg
ala ser ser thr met gly arg his leu gly asp thr val glu val gly ala arg arg leu
481/161  511/171
cgg gtc gtt ggc att gtg ccg aat tcc acc gcg ctg gcc aag atc ccc aat gtc ttc ctc
arg val val gly ile val pro asn ser thr ala leu ala lys ile pro asn val phe leu
541/181  571/191
acg acc gag ggc tta cag aaa ttg gcg tac aac ggg cag ccg aat atc acg tcc atc ggg
thr thr glu gly leu gln lys leu ala tyr asn gly gln pro asn ile thr ser ile gly
601/201  631/211
atc ata ggt atg ccc cga cag ctg ccg gag ggt tac cag act ttc gat cgg gtg ggc gct
ile ile gly met pro arg gln leu pro glu gly tyr gln thr phe asp arg val gly ala
661/221  691/231
gtc aat gat ttg gtg cgc cca ttg aag gtc gca gtg aat tcg atc tcg atc gtg gct gtt
val asn asp leu val arg pro leu lys val ala val asn ser ile ser ile val ala val
721/241  751/251
ttg ctg tgg att gtg gcg gtg ctg atc gtc ggc tcg gtg gtg tac ctt tcg gct ctt gag
leu leu trp ile val ala val leu ile val gly ser val val tyr leu ser ala leu glu
781/261  811/271
cgg cta cgt gac ttc gcg gtg ttc aag gcg att ggc acg cca acg cgc tcg att atg gcc
arg leu arg asp phe ala val phe lys ala ile gly thr pro thr arg ser ile met ala
841/281  871/291
ggg ctc gca tta cag gcg ctg gtc att gcg ttg ctt gcg gcg gtg gtg ggc gtc gtc ctg
gly leu ala leu gln ala leu val ile ala leu leu ala ala val val gly val val leu
901/301  931/311
gcg cag gtg ttg gca cca ctg ttt ccg atg att gtc gcg gta ccc gtc ggt gct tac ctg
ala gln val leu ala pro leu phe pro met ile val ala val pro val gly ala tyr leu
961/321  991/331
gcg cta ccg gtg gcc gcg atc gtc atc ggt ctg ttc gct agt gtt gcc gga ttg aag cgc
ala leu pro val ala ala ile val ile gly leu phe ala ser val ala gly leu lys arg
1021/341  1051/351
gtg gtg acg gtc gat ccc gcg cag gcg ttc gga ggt ccc tag
val val thr val asp pro ala gln ala phe gly gly pro)AMB

SEQ ID NOS:156-157

FIG. 8G

SEQ ID NO: 158                               31/11
CGA GGC CGA GCG AAC CGT CGA TTC CAT GGG TGT CGA CGC ATT CGT GGT CAA GGC CGG CGC
(arg gly arg ala asn arg arg phe his gly cys arg arg ile arg gly gln gly arg arg
61/21        SEQ ID NO: 159                  91/31
GGC AGG ACC GTT CCT GGG TTC GAC ACC ATT CGC CCA AAT CGA CCT GCC CCA GGT TGC TCG
gly arg thr val pro gly phe asp thr ile arg pro asn arg pro ala pro gly cys ser
121/41                                       151/51
TGC GCC TGG CGT CTT GGC TGC CGC CCC ACT AGC GAC TGC GCC GTC GAC GAT CCG GCA GGG
cys ala trp arg leu gly cys arg pro thr ser asp cys ala val asp asp pro ala gly
181/61                                       211/71
CAC GTC AGC GCG AAA CGT CAC CGC GTT CGG GGC ACC AGA GCA CGG ACC CGG CAT GCC GCG
his val ser ala lys arg his arg val arg gly thr arg ala arg thr arg his ala ala
241/81                                       271/91
GGT CTC GGA CGG TCG GGC GCC ATC GAC GCC GGA CGA GGT CGC GGT GTC GAG CAC GCT GGG
gly leu gly arg ser gly ala ile asp ala gly arg gly arg gly val glu his ala gly
301/101
CCG AAA CCT CGG CGA CGA TC
pro lys pro arg arg arg)

SEQ ID NOS:158-159

FIG. 9A

SEQ ID NO: 160                               32/11
GAG GCC GAG CGA ACC GTC GAT TCC ATG GGT GTC GAC GCA TTC GTG GTC AAG GCC GGC GCG
(glu ala glu arg thr val asp ser met gly val asp ala phe val val lys ala gly ala
62/21        SEQ ID NO: 161                  92/31
GCA GGA CCG TTC CTG GGT TCG ACA CCA TTC GCC CAA ATC GAC CTG CCC GAG GTT GCT CGT
ala gly pro phe leu gly ser thr pro phe ala gln ile asp leu pro gln val ala arg
122/41                                       152/51
GCG CCT GGC GTC TTG GCT GCC GCC CCA CTA GCG ACT GCG CCG TCG ACG ATC GGC AGG GC
ala pro gly val leu ala ala ala pro leu ala thr ala pro ser thr ile arg gln gly
182/61                                       212/71
ACG TCA GCG CGA AAC GTC ACC GCG TTC GGG GCA CCA GAG CAC GGA CCC GGC ATG CCG CGG
thr ser ala arg asn val thr ala phe gly ala pro glu his gly pro gly met pro arg
242/81                                       272/91
GTC TCG GAC GGT CGG GCG CCA TCG ACG CCG GAC GAG GTC GCG GTG TCG AGC ACG CTG GGC
val ser asp gly arg ala pro ser thr pro asp glu val ala val ser ser thr leu gly
302/101
CGA AAC CTC GGC GAC GAT C
arg asn leu gly asp asp)

SEQ ID NOS:160-161

FIG. 9B

```
                SEQ ID NO: 162                        33/11
AGG CCG AGC GAA CCG TCG ATT CCA TGG GTG TCG ACG CAT TCG TGG TCA AGG CCG GCG CGG
(arg pro ser glu pro ser ile pro trp val ser thr his ser trp ser arg pro ala arg
 63/21    SEQ ID NO: 163                         93/31
CAG GAC CGT TCC TGG GTT CGA CAC CAT TCG CCC AAA TCG ACC TGC CCC AGG TTG CTC GTG
gln asp arg ser trp val arg his his ser pro lys ser thr cys pro arg leu leu val
123/41                                           153/51
CGC CTG GCG TCT TGG CTG CCG CCC CAC TAG CGA CTG CGC CGT CGA CGA TCC GGC AGG GCA
arg leu ala ser trp leu pro pro his)AMB(arg leu arg arg arg arg ser gly arg ala
183/61         SEQ ID NO: 164                    213/71
CGT CAG CGC GAA ACG TCA CCG CGT TCG GGG CAC CAG AGC ACG GAC CCG GCA TGC CGC GGG
arg gln arg glu thr ser pro arg ser gly his gln ser thr asp pro ala cys arg gly
243/81                                           273/91
TCT CGG ACG GTC GGG CGC CAT CGA CGC CGG ACG AGG TCG CGG TGT CGA GCA CGC TGG GCC
ser arg thr val gly arg his arg arg arg thr arg ser arg cys arg ala arg trp ala
303/101
GAA ACC TCG GCG ACG ATC
glu thr.ser ala thr ile)
```

SEQ ID NOS:162-164

FIG. 9C

```
                SEQ ID NO: 165                        31/11
TTA ACG ACT CAG ACG GAA ACG CTT GAA CCG CGA GGT CGC TCC GGA CAC CAA TTT GAC TCG
(leu thr thr gln thr glu thr leu glu pro arg gly arg ser gly his gln phe asp ser
 61/21    SEQ ID NO: 166                         91/31
GCT CTT TGG CAA TTG AAG GTG AGC TGC GAG CAG CCG GGT GAC CGC ATC GTT GGC CTT GCC
ala leu trp gln leu lys val ser cys glu gln pro gly asp arg ile val gly leu ala
121/41                                           151/51
ATC AAT CGC CGG CTC GCG GAC GTA GAT AAT CAG CTC ACC GTT GGG ACC GAC CTC GAC CAG
ile asn arg arg leu ala asp val asp asn gln leu thr val gly thr asp leu asp gln
181/61                                           211/71
GGG TCC TTT GTG ACT GCC GGG CTT GAC GCG GAC GAC CAC AGA GTC GGT CAT CGC CTA AGG
gly ser phe val thr ala gly leu asp ala asp asp his arg val gly his arg leu arg
241/81                                           271/91
CTA CCG TTC TGA CCT GGG GCT GCG TGG GCG CCG ACG ACG TGA GGC ACG TCA TGT CTC AGC
leu pro phe)OPA(pro gly ala ala trp ala pro thr thr)OPA(gly thr ser cys leu ser
301/101            SEQ ID NO: 167             331/111       SEQ ID NO: 168
GGC CCA CCG CCA CCT CGG TCG CCG GCA GTA TGT CAG CAT GTG CAG ATG ACT CCA CGC AGC
gly pro pro pro pro arg ser pro ala val cys gln his val gln met thr pro arg ser
361/121                                          391/131
CTT GTT CGC ATC GTT GGT GTC GTG GTT GCG ACG ACC TTG GCG CTG GTG AGC GCA CCC GCC
leu val arg ile val gly val val val ala thr thr leu ala leu val ser ala pro ala
421/141
GGC GGT CGT GCC GCG CAT GCG GAT C
gly gly arg ala ala his ala asp)
```

SEQ ID NOS:165-168

FIG. 10A

```
          SEQ ID NO: 169                          32/11
TAA CGA CTC AGA CGG AAA CGC TTG AAC CGC GAG GTC GCT CCG GAC ACC AAT TTG ACT CGG
OCH(arg leu arg arg lys arg leu asn arg glu val ala pro asp thr asn leu thr arg
62/21       SEQ ID NO: 170                        92/31
CTC TTT GGC AAT TGA AGG TGA GCT GCG AGC AGC CGG GTG ACC GCA TCG TTG GCC TTG CCA
leu phe gly asn)OPA(arg OPA(ala ala ser ser arg val thr ala ser leu ala leu pro
122/41    SEQ ID NO: 171                          152/51
TCA ATC GCC GGC TCG CGG ACG TAG ATA ATC AGC TCA CCG TTG GGA CCG ACC TCG ACC AGG
ser ile ala gly ser arg thr)AMB(ile ile ser ser pro leu gly pro thr ser thr arg
182/61           SEQ ID NO: 172                   212/71
GGT CCT TTG TGA CTG CCG GGC TTG ACG CGG ACG ACC ACA GAG TCG GTC ATC GCC TAA GGC
gly pro leu)OPA(leu pro gly leu thr arg thr thr thr glu ser val ile ala)OCH(gly
242/81           SEQ ID NO: 173                   272/91         SEQ ID NO: 174
TAC CGT TCT GAC CTG GGG CTG CGT GGG CGC CGA CGA CGT GAG GCA CGT CAT GTC TCA GCG
tyr arg ser asp leu gly leu arg gly arg arg arg arg glu ala arg his val ser ala
302/101                                           332/111
GCC CAC CGC GAC CTC GGT CGC CGG CAG TAT GTC AGC ATG TGC AGA TGA CTC CAC GCA GCC
ala his arg his leu gly arg arg gln tyr val ser met cys arg)OPA(leu his ala ala
362/121                                           392/131 SEQ ID NO: 175
TTG TTC GCA TCG TTG GTG TCG TGG TTG CGA CGA CCT TGG CGC TGG TGA GCG CAC CCG CCG
leu phe ala ser leu val ser trp leu arg arg pro trp arg trp)OPA(ala his pro pro
422/141                                                  SEQ ID NO: 176
GCG GTC GTG CCG CGC ATG CGG ATC
ala val val pro arg met arg Ile)

SEQ ID NOS:170-176

FIG. 10B

SEQ ID NO: 177      SEQ ID NO: 179      33/11
AAC GAC TCA GAC GGA AAC GCT TGA ACC GCG AGG TCG CTC CGG ACA CCA ATT TGA CTC GGC
(asn asp ser asp gly asn ala)OPA(thr ala arg ser leu arg thr pro ile)OPA(leu gly
63/21       SEQ ID NO: 178                        93/31     SEQ ID NO: 180
TCT TTG GCA ATT GAA GGT GAG CTG CGA GCA GCC GGG TGA CCG CAT CGT TGG CCT TGC CAT
ser leu ala ile glu gly glu leu arg ala ala gly)OPA(pro his arg trp pro cys his
123/41                                            153/51    SEQ ID NO: 181
CAA TCG CCG GCT CGC GGA CGT AGA TAA TCA GCT CAC CGT TGG GAC CGA CCT CGA CCA GGG
gln ser pro ala arg gly arg arg)OCH(ser ala his arg trp asp arg pro arg pro gly
183/61           SEQ ID NO: 182                   213/71
GTC CTT TGT GAC TGC CGG GCT TGA CGC GGA CGA CCA CAG AGT CGG TCA TCG CCT AAG GCT
val leu cys asp cys arg ala)OPA(arg gly arg pro gln ser arg ser ser pro lys ala
243/81           SEQ ID NO: 183                   273/91
ACC GTT CTG ACC TGG GGC TGC GTG GGC GCC GAC GAC GTG AGG CAC GTC ATG TCT CAG CGG
thr val leu thr trp gly cys val gly ala asp asp val arg his val met ser gln arg
303/101                                           333/111
CCC ACC GCC ACC TCG GTC GCC GGC AGT ATG TCA GCA TGT GCA GAT GAC TCC ACG CAG CCT
pro thr ala thr ser val ala gly ser met ser ala cys ala asp asp ser thr gln pro
363/121                                           393/131
TGT TCG CAT CGT TGG TGT CGT GGT TGC GAC GAC CTT GGC GCT GGT GAG CGC ACC GCC GG
cys ser his arg trp cys arg gly cys asp asp leu gly ala gly glu arg thr arg arg
423/141
CGG TCG TGC CGC GCA TGC GGA TC
arg ser cys arg ala cys gly)
```

SEQ ID NOS:177-183

FIG. 10C

```
SEQ ID NO: 184                          31/11
CCC GAA GAG GTC CCC CGT TTT GTT AAT TTT TAA AAA ATT TGT GTC ACA AAC CGG GGT ACC
(pro glu glu val pro arg phe val asp phe)OCH(lys ile cys val thr lys arg gly thr
 61/21        SEQ ID NO: 185              91/31     SEQ ID NO: 186
AAG GCA TAA AAC CTA GTA CCT GGG GCG GCG GAT TCA ACG AAA ACC GAG TGG GGG TAG TCA
lys ala)OCH(asn leu val pro gly ala ala asp ser thr lys thr glu trp gly)AMB(ser
121/41         SEQ ID NO: 187            151/51              SEQ ID NO: 188
GGG GCG TGC ATT CCG ACG ACC CTG TAC GAC CCG CTG GTG GCA ACG CCG ATG AGT GCG CCG
gly ala cys ile pro thr thr leu tyr asp pro leu val ala thr pro met ser ala pro
181/61                                   211/71
ACG AAG GCC GAG CGA CGG GCT GCC GGC GCT GAC CGC CGC GGA AGC CGC CGA GTG CAT GGT
thr lys ala glu arg arg ala ala gly ala asp arg arg gly ser arg arg val asp gly
241/81                                   271/91
CAC CAC CGC CCG CAC CCG ACC GGT ACG GAT CGC GCC TCG GGT TAC CGT CGC CGT CAA CGC
his his arg pro his pro thr gly thr asp arg ala ser gly tyr arg arg arg gln arg
301/101                                  331/111
GCT GGA CAG CAT CGG TCC CCG CTG GGT CAA TGC ACT CAT GCA GCC GCG CAA CGA ACA GCT
ala gly gln his arg ser pro leu gly gln cys thr his ala ala pro gln arg thr ala
361/121                                  391/131
CAA CCC TTG AAC CGG GTC CCG GCC TGC CGA CCC TCG GCC GCC GGC GTG CCG CTA CGT GAT
gln pro leu asn arg val pro ala cys arg pro ser ala ala gly val pro leu arg asp
421/141                                  451/151
AGA CAC AGG GCC ATG GAA ATC CTG GCC AGC CGG ATG CTA CTT CGG CCG GCG GAC TAT CAG
arg his arg ala met glu ile leu ala ser arg met leu leu arg pro ala asp tyr gln
481/161
CGG TCG CTG AGC TTC TAC CGT GAC CAG ATC
arg ser leu ser phe tyr arg asp gln ile)

SEQ ID NOS:184-188

FIG. 11A
```

```
SEQ ID NO: 189                          32/11
CCG AAG AGG TCC CCC GTT TTG TTA ATT TTT AAA AAA TTT GTG TCA CAA AGC GGG GTA CCA
(pro lys arg ser pro val leu leu ile phe lys lys phe val ser gln ser gly val pro
 62/21     SEQ ID NO: 190                 92/31
AGG CAT AAA ACC TAG TAC CTG GGC GGC GGA TTC AAC GAA ACC GAG TGG GGG TAG TCA G
arg his lys thr)AMB(tyr leu gly arg arg ile gln arg lys pro ser gly gly ser gln
122/41           SEQ ID NO: 191          152/51
GGG CGT GCA TTC CGA CGA CCC TGT ACG ACC CGC TGG TGG CAA CGC CGA TGA GTG CGC CGA
gly arg ala phe arg arg pro cys thr thr arg trp trp gln arg arg)OPA(val arg arg
182/61                                   212/71       SEQ ID NO: 192
CGA AGG CCG AGC GAC GGG CTG CCG GCG CTG ACC GCC GCG GAA GCC GCC GAG TGG ATG GTC
arg arg pro ser asp gly leu pro ala leu thr ala ala glu ala ala glu trp met val
242/81                                   272/91
ACC ACC GCC CGC ACC CGA CCG GTA CGG ATC GCG CCT CGG GTT ACC GTC GCC GTC AAC GCG
thr thr ala arg thr arg pro val arg ile ala pro arg val thr val ala val asn ala
302/101                                  332/111
CTG GAC AGC ATC GGT CCC GCC TGG GTC AAT GCA CTC ATG CAG CGC GCA ACG AAC AGC TC
leu asp ser ile gly pro arg trp val asn ala leu met gln arg arg asn glu gln leu
362/121                                  392/131
AAC CCT TGA ACC GGG TCC CGG CCT GCC GAC CCT CGG CCG CCG GCG TGC CGC TAC GTG ATA
asn pro)OPA(thr gly ser arg pro ala asp pro arg pro pro ala cys arg tyr val ile
422/141         SEQ ID NO: 193           452/151
GAC ACA GGG CCA TGG AAA TCC TGG CCA GCC GGA TGC TAC TTC GCC GGC GGA CTA TCA GC
asp thr gly pro trp lys ser trp pro ala gly cys tyr phe gly arg arg thr ile ser
482/161
GGT CGC TGA GCT TCT ACC GTG ACC AGA TC
gly ar) OPA(ala ser thr val thr arg)
           SEQ ID NO: 194

SEQ ID NOS:189-194

FIG. 11B
```

```
      SEQ ID NO: 195                          33/11
CGA AGA GGT CCC CCG TTT TGT TAA TTT TTA AAA AAT TTG TGT CAC AAA GCG GGG TAC CAA
(arg arg gly pro pro phe cys)OCH(phe leu lys asn leu cys his lys ala gly tyr gln
 63/21     SEQ ID NO:  196              93/31    SEQ ID NO:  197
GGC ATA AAA CCT AGT ACC TGG GGC GGC GGA TTC AAC GAA AAC CGA GTG GGG GTA GTC AGG
gly ile lys pro ser thr trp gly gly gly phe asn glu asn arg val gly val val arg
123/41                                        153/51
GGC GTG CAT TCC GAC GAC CCT GTA CGA CCC GCT GGT GGC AAC GCC GAT GAG TGC GCC GAC
gly val his ser asp asp pro val arg pro ala gly gly asn ala asp glu cys ala asp
183/61                                        213/71
GAA GGC CGA GCG ACG GGC TGC CGG CGC TGA CCG CCG CGG AAG CCG CCG AGT GGA TGG TCA
glu gly arg ala thr gly cys arg arg)OPA(pro pro arg lys pro pro ser gly trp ser
243/81               SEQ ID NO:  198       273/91
CCA CCG CCC GCA CCC GAC CGG TAC GGA TCG CGC CTC GGG TTA CCG TCG CCG TCA ACG CGC
pro pro pro ala pro asp arg tyr gly ser arg leu gly leu pro ser pro ser thr arg
303/101                                       333/111
TGG ACA GCA TCG GTC CCC GCT GGG TCA ATG CAC TCA TGC AGC GCC GCA ACG AAC AGC TCA
trp thr ala ser val pro ala gly ser met his ser cys ser ala ala thr asn ser ser
363/121                                       393/131
ACC CTT GAA CCG GGT CCC GGC CTG CCG ACC CTC GGC CGC CGG CGT GCC GCT ACG TGA TAG
thr leu glu pro gly pro gly leu pro thr leu gly arg arg arg ala ala thr)OPA AMB
423/141                                       453/151
ACA CAG GGC CAT GGA AAT CCT GGC CAG CCG GAT GCT ACT TCG GCC GGC GGA CTA TCA GCG
(thr gln gly his gly asn pro gly gln pro asp ala thr ser ala gly gly leu ser ala
483/161      SEQ ID NO:  199
GTC GCT GAG CTT CTA CCG TGA CCA GAT C
val ala glu leu leu pro)OPA pro asp
```

SEQ ID NOS:195-199

FIG. 11C

```
part of the nucleotide sequence of Seq11
1/1    SEQ ID NO:  200                31/11
CGT CGC CGT CAA CGC GCT GGA CAG CAT CGG TCC CCG CTG GGT CAA TGC ACT CAT GCA GCG
(arg arg arg gln arg ala gly gln his arg ser pro leu gly gln cys thr his ala ala
 61/21     SEQ ID NO:  201              91/31
CCG CAA CGA ACA GCT CAA CCC TTG AAC CGG GTC CCG GCC TGC CGA CCC TCG GCC GCC GGC
pro gln arg thr ala gln pro leu asn arg val pro ala cys arg pro ser ala ala gly
121/41                                      151/51
GTG CCG CTA CGT GAT AGA CAC AGG GCC ATG GAA ATC CTG GCC AGC GGA TGC TAC TTC GG
val pro leu arg asp arg his arg ala met glu ile leu ala ser arg met leu leu arg
181/61                                      211/71
CCG GCG GAC TAT CAG CGG TCG CTG AGC TTC TAC CGT GAC CAG ATC
pro ala asp tyr gln arg ser leu ser phe tyr arg asp gln ile)
```

SEQ ID NOS:200-201

FIG. 11A'

```
1/1  ─SEQ ID NO: 202                    31/11
GTC GCC GTC AAC GCG CTG GAC AGC ATC GGT CCC CGC TGG GTC AAT GCA CTC ATG CAG CGC
(val ala val asn ala leu asp ser ile gly pro arg trp val asn ala leu met gln arg
61/21  ─SEQ ID NO: 203                  91/31
CGC AAC GAA CAG CTC AAC CCT TGA ACC GGG TCC CGG CCT GCC GAC CCT CGG CCG CCG GCG
arg asn glu gln leu asn pro)OPA(thr gly ser arg pro ala asp pro arg pro pro ala
121/41       SEQ ID NO: 204             151/51
TGC CGC TAC GTG ATA GAC ACA GGG CCA TGG AAA TCC TGG CCA GCC GGA TGC TAC TTC GGC
cys arg tyr val ile asp thr gly pro trp lys ser trp pro ala gly cys tyr phe gly
181/61                                  211/71
CGG CGG ACT ATC AGC GGT CGC TGA GCT TCT ACC GTG ACC AGA TC
arg arg thr ile ser gly arg)OPA(ala ser thr val thr arg)
         SEQ ID NO: 205
```

SEQ ID NOS:202-205

FIG. 11B'

```
1/1  ─ SEQ ID NO: 206                   31/11
TCG CCG TCA ACG CGC TGG ACA GCA TCG GTC CCC GCT GGG TCA ATG CAC TCA TGC AGC GCC
(ser pro ser thr arg trp thr ala ser val pro ala gly ser met his ser cys ser ala
61/21  ─ SEQ ID NO: 207                 91/31
GCA ACG AAC AGC TCA ACC CTT GAA CCG GGT CCC GGC CTG CCG ACC CTC GGC CGC GGC CGT
ala thr asn ser ser thr leu glu pro gly pro gly leu pro thr leu gly arg arg arg
121/41                                  151/51
GCC GCT ACG TGA TAG ACA CAG GGC CAT GGA AAT CCT GGC CAG CCG GAT GCT ACT TCG GCC
ala ala thr)OPA AMB(thr gln gly his gly asn pro gly gln pro asp ala thr ser ala
181/61         ─SEQ ID NO: 208          211/71
GGC GGA CTA TCA GCG GTC GCT GAG CTT CTA CCG TGA CCA GAT C
gly gly leu ser ala val ala glu leu leu pro)OPA pro asp
```

SEQ ID NOS:206-208

FIG. 11C' sequence Rv0546c predicted by Cole et al. (Nature 393:537-544) and containing Seq11A'

```
1/1  ─ SEQ ID NO: 209                   31/11
atg gaa atc ctg gcc agc cgg atg cta ctt cgg ccg gcg gac tat cag cgg tcg ctg agc
(Met glu ile leu ala ser arg met leu leu arg pro ala asp tyr gln arg ser leu ser
61/21  ─SEQ ID NO: 210                  91/31
ttc tac cgt gac cag atc ggg ctg gcg att gcc cgt gaa tac ggg gcc ggc aca gtg ttt
phe tyr arg asp gln ile gly leu ala ile ala arg glu tyr gly ala gly thr val phe
121/41                                  151/51
ttc gcc ggt cag tca ctg ctc gaa ctg gcc ggt tac ggc gag ccg gac cat tcg cgg gga
phe ala gly gln ser leu leu glu leu ala gly tyr gly glu pro asp his ser arg gly
181/61                                  211/71
cct ttt ccc ggc gcg ctg tgg ctg cag gtg cgc gac ctc gag gct acc cag acc gag ctg
pro phe pro gly ala leu trp leu gln val arg asp leu glu ala thr gln thr glu leu
241/81                                  271/91
gtc agc cga ggc gtg tcg atc gct cgc gag ccc cgc cgc gaa ccg tgg ggc ctg cac gag
val ser arg gly val ser ile ala arg glu pro arg arg glu pro trp gly leu his glu
301/101                                 331/111
atg cat gtg acc gac cca gac ggg atc aca ctg ata ttc gtc gag gtt ccc gag ggt cac
met his val thr asp pro asp gly ile thr leu ile phe val glu val pro glu gly his
361/121
ccg ctg cgt aca gac acc cgg gcg tga
pro leu arg thr asp thr arg ala)OPA
```

SEQ ID NOS:209-210

FIG. 11D

ORF predicted by Cole et al. (Nature 393:537-544) and containing Rv0546c

```
1/1   SEQ ID NO: 211                    31/11
tag tca ggg cgt gca ttc gac gac gct gta cta ccc gct ggt ggc aac tcc gat gat tgc
AMB(ser gly arg ala phe asp asp ala val leu pro ala gly gly asn ser asp asp cys
61/21  SEQ ID NO: 212                   91/31
gcc gac gaa ggc cta cga cgg gct gcc ggc gct gac cgc cgc gga agc cgc cga gtg gat
ala asp glu gly leu arg arg ala ala gly ala asp arg arg gly ser arg arg val asp
121/41                                  151/51
ggt cac cgc cgc ccg cac ccg acc ggt gcg gat cgc gcc tcg ggt tgc cgt cgc cgt caa
gly his arg arg pro his pro thr gly ala asp arg ala ser gly cys arg arg arg gln
181/61                                  211/71
cgc gct gga cag cat cgg tcc ccg ctg ggt caa tgc act cat gca gcg ccg caa cga aca
arg ala gly gln his arg ser pro leu gly gln cys thr his ala ala pro gln arg thr
241/81                                  271/91
gct caa ccc ttg aac cgg gtc ccg gcc tgc cga ccc tcg gcc gcc ggc gtg ccg cta cgt
ala gln pro leu asn arg val pro ala cys arg pro ser ala ala gly val pro leu arg
301/101                                 331/111
gat aga cac agg gcc atg gaa atc ctg gcc agc cgg atg cta ctt cgg ccg gcg gac tat
asp arg his arg ala met glu ile leu ala ser arg met leu leu arg pro ala asp tyr
361/121                                 391/131
cag cgg tcg ctg agc ttc tac cgt gac cag atc ggg ctg gcg att gcc cgt gaa tac ggg
gln arg ser leu ser phe tyr arg asp gln ile gly leu ala ile ala arg glu tyr gly
421/141                                 451/151
gcc ggc aca gtg ttt ttc gcc ggt cag tca ctg ctc gaa ctg gcc ggt tac ggc gag ccg
ala gly thr val phe phe ala gly gln ser leu leu glu leu ala gly tyr gly glu pro
481/161                                 511/171
gac cat tcg cgg gga cct ttt ccc ggc gcg ctg tgg ctg cag gtg cgc gac ctc gag gct
asp his ser arg gly pro phe pro gly ala leu trp leu gln val arg asp leu glu ala
541/181                                 571/191
acc cag acc gag ctg gtc agc cga ggc gtg tcg atc gct cgc gag ccc cgc cgc gaa ccg
thr gln thr glu leu val ser arg gly val ser ile ala arg glu pro arg arg glu pro
601/201                                 631/211
tgg ggc ctg cac gag atg cat gtg acc gac cca cag ggg atc aca ctg ata ttc gtc gag
trp gly leu his glu met his val thr asp pro asp gly ile thr leu ile phe val glu
661/221                                 691/231
gtt ccc gag ggt cac ccg ctg cgt aca gac acc cgg gcg tga
val pro glu gly his pro leu arg thr asp thr arg ala)OPA
```

SEQ ID NOS:211-212

FIG. 11E

```
1/1   SEQ ID NO: 213                          31/11
gac cga agg gat ttc gcg act aac tcg gcc tgt aag gca acg cga ggt ctt cat gcc gag
(asp arg arg asp phe ala thr asn ser ala cys lys ala thr arg gly leu his ala glu
61/21   SEQ ID NO: 214                        91/31
gac gta gac agg aag aga cag gga agc tga tga cgt cgc gta ccg gac cgc cat tct gtc
asp val asp arg lys arg gln gly ser)OPA OPA(arg arg val pro asp arg his ser val
121/41                                        151/51   SEQ ID NO: 215
gag tct ttc cga gtt cag caa caa tcg aca cag aag cgg gga cca gac cgg gag gac gac
glu ser phe arg val gln gln gln ser thr gln lys arg gly pro asp arg glu asp asp
181/61                                        211/71
gcg gcc cgg gcc gct tcg ggc cga gtg tct gag taa gac cag agt cac ggg tcc gtg tgt
ala ala arg ala ala ser gly arg val ser glu)OCH(asp gln ser his gly ser val cys
241/81                                        271/91   SEQ ID NO: 216
gac aac cgc gcg gaa ttc aat cgg atg gcg ggc ggg acc gga ttg cgc cgg tca ccg agg
asp asn arg ala glu phe asn arg met ala gly gly thr gly leu arg arg ser pro arg
301/101
aac ctc cgg agt gat c
asn leu arg ser asp)
```

SEQ ID NOS:213-216

FIG. 12A

```
1/1   SEQ ID NO: 217                          31/11
acc gaa ggg att tcg cga cta act cgg cct gta agg caa cgc gag gtc ttc atg ccg agg
(thr glu gly ile ser arg leu thr arg pro val arg gln arg glu val phe met pro arg
61/21   SEQ ID NO: 218                        91/31
acg tag aca gga aga gac agg gaa gct gat gac gtc gcg tac cgg acc gcc att ctg tcg
thr)AMB(thr gly arg asp arg glu ala asp asp val ala tyr arg thr ala ile leu ser
121/41   SEQ ID NO: 219                       151/51
agt ctt tcc gag ttc agc aac aat cga cac aga agc ggg gac cag acc ggg agg acg acg
ser leu ser glu phe ser asn asn arg his arg ser gly asp gln thr gly arg thr thr
181/61                                        211/71
cgg ccc ggg ccg ctt cgg gcc gag tgt ctg agt aag acc aga gtc acg ggt ccg tgt gtg
arg pro gly pro leu arg ala glu cys leu ser lys thr arg val thr gly pro cys val
241/81                                        271/91
aca acc gcg cgg aat tca atc gga tgg cgg gcg gga ccg gat tgc gcc ggt cac cga gga
thr thr ala arg asn ser ile gly trp arg ala gly pro asp cys ala gly his arg gly
301/101
acc tcc gga gtg atc
thr ser gly val ile)
```

SEQ ID NOS:217-219

FIG. 12B

1/1 SEQ ID NO: 220                                31/11
ccg aag gga ttt cgc gac taa ctc ggc ctg taa ggc aac gcg agg tct tca tgc cga gga
(pro lys gly phe arg asp)OCH leu gly leu OCH(gly asn ala arg ser ser cys arg gly
61/21 SEQ ID NO: 221                              91/31   SEQ ID NO: 222
cgt aga cag gaa gag aca ggg aag ctg atg acg tcg cgt acc gga ccg cca ttc tgt cga
arg arg gln glu glu thr gly lys leu met thr ser arg thr gly pro pro phe cys arg
121/41                                            151/51
gtc ttt ccg agt tca gca aca atc gac aca gaa gcg ggg acc aga ccg gga gga cga cgc
val phe pro ser ser ala thr ile asp thr glu ala gly thr arg pro gly gly arg arg
181/61                                            211/71
ggc ccg ggc cgc ttc ggg ccg agt gtc tga gta aga cca gag tca cgg gtc cgt gtg tga
gly pro gly arg phe gly pro ser val)OPA(val arg pro glu ser arg val arg val)OPA
241/81         SEQ ID NO: 223                     271/91
caa ccg cgc gga att caa tcg gat ggc ggg cgg gac cgg att gcg ccg gtc acc gag gaa
(gln pro arg gly ile gln ser asp gly gly arg asp arg ile ala pro val thr glu glu
301/101 SEQ ID NO: 224
cct ccg gag tga tc
pro pro glu)OPA

SEQ ID NOS:220-224

FIG. 12C

1/1 SEQ ID NO: 225                                31/11
GGG ATT TCG TTG CCC GAT GGA TTG TTT GTA CGG TTT GGG AAA AAC ACT TGA AGT CCT TTT
(gly ile ser leu pro asp gly leu phe val arg phe gly lys asn thr)OPA(ser pro phe
61/21  SEQ ID NO: 226                             91/31  SEQ ID NO: 227
TAT TGG CAA TGC TGG AAA TGG ACA TTC CAA TAT TGC GCG AAT TAA CCG AAC ACG GTG AGG
tyr trp gln cys trp lys trp thr phe gln tyr cys ala asn)OCH(pro asn thr val arg
121/41                                            151/51          SEQ ID NO: 923
GGG GGG CAA GCG TTT GTA CCG GGG CCA GCA AGC GCC GCC GAC CGG TTG ACC GAA GCC AGC
gly gly gln ala phe val pro gly pro ala ser ala ala asp arg leu thr glu ala ser
181/61                                            211/71
ATG TTG TTG TGT CAG CGC GGG CTT GGT CTC GAT GTC CCG GCC TTG GCT GGA CCC GCT TCT
met leu leu cys gln arg gly leu gly leu asp val pro ala leu ala gly pro ala ser
241/81                                            271/91
TCA AAA CAG GTT GAA CTT AAC GAC TCA AGA ACG GAA ACG CTT GAA CCG CGA CGT CGC TCC
ser lys gln val glu leu asn asp ser arg thr glu thr leu glu pro arg arg arg ser
301/101                                           331/111
GGA CAC CAA TTT GAC TCG GCT CTT TGG CAA TTG AAG GTG AGC TGC GAG CAG CCG GGT GAC
gly his gln phe asp ser ala leu trp gln leu lys val ser cys glu gln pro gly asp
361/121                                           391/131
CGC ATC GTT GGC CTT GCC ATC AAT CGC CGG CTC GCG GAC GTA GAT AAT CAG CTC ACC GTT
arg ile val gly leu ala ile asn arg arg leu ala asp val asp asn gln leu thr val
421/141                                           451/151
GGG ACC GAC CTC GAC CAG GGG TCC TTT GTG ACT GCC GGG CTT GAC GCG GAC GAC CAC AGA
gly thr asp leu asp gln gly ser phe val thr ala gly leu asp ala asp asp his arg
481/161                                           511/171
GTC GGT CAT CGC CTA AGG CTA CCG TTC TGA CCT GGG GCT GCG TGG GCG CCG ACG ACG TGA
val gly his arg leu arg leu pro phe)OPA(pro gly ala ala trp ala pro thr thr)OPA
541/181               SEQ ID NO: 924   571/191
GGC ACG TCA TGT CTC AGC GGC CCA CCG CCA CCT CGG TCG CCG GCA GTA TGT CAG CAT GTG
(gly thr ser cys leu ser gly pro pro pro arg ser pro ala val cys gln his val
601/201 SEQ ID NO: 925                            631/211
CAG ATG ACT CCA CGC AGC CTT GTT CGC ATC GTT GGT GTC GTG GTT GCG ACG ACC TTG GCG
gln met thr pro arg ser leu val arg ile val gly val val val ala thr thr leu ala
661/221                                           691/231
CTG GTG AGC GCA CCC GCC GGC GGT CGT GCC GCG CAT GCG GAT C
leu val ser ala pro ala gly gly arg ala ala his ala asp)

SEQ ID NOS:220-227,923-925

FIG. 13A

```
       SEQ ID NO: 228                        32/11
GGA TTT CGT TGC CCG ATG GAT TGT TTG TAC GGT TTG GGA AAA ACA CTT GAA GTC CTT TTT
(gly phe arg cys pro met asp cys leu tyr gly leu gly lys thr leu glu val leu phe
62/21       SEQ ID NO:  229                 92/31
ATT GGC AAT GCT GGA AAT GGA CAT TCC AAT ATT GCG CGA ATT AAC CGA ACA CGG TGA GGG
ile gly asn ala gly asn gly his ser asn ile ala arg ile asn arg thr arg)OPA(gly
122/41                                      152/51          SEQ ID NO:  230
GGG GGC AAG CGT TTG TAC CGG GGC CAG CAA GCG CCG CCG ACC GGT TGA CCG AAG CCA GCA
gly gly lys arg leu tyr arg gly gln gln ala pro pro thr gly)OPA(pro lys pro ala
182/61                                      212/71    SEQ ID NO:  231
TGT TGT TGT GTC AGC GCG GGC TTG GTC TCG ATG TCC CGG CCT TGG CTG GAC CCG CTT CTT
cys cys cys val ser ala gly leu val ser met ser arg pro trp leu asp pro leu leu
242/81                                      272/91
CAA AAC AGG TTG AAC TTA ACG ACT CAA GAA CGG AAA CGC TTG AAC CGC GAC GTC GCT CCG
gln asn arg leu asn leu thr thr gln glu arg lys arg leu asn arg asp val ala pro
302/101                                     332/111
GAC ACC AAT TTG ACT CGG CTC TTT GGC AAT TGA AGG TGA GCT GCG AGC AGC CGG GTG ACC
asp thr asn leu thr arg leu phe gly asn)OPA arg OPA(ala ala ser ser arg val thr
362/121                                     392/131       SEQ ID NO:  232
GCA TCG TTG GCC TTG CCA TCA ATC GCC GGC TCG CGG ACG TAG ATA ATC AGC TCA CCG TTG
ala ser leu ala leu pro ser ile ala gly ser arg thr)AMB(ile ile ser ser pro leu
422/141                                     452/151      SEQ ID NO:  233
GGA CCG ACC TCG ACC AGG GGT CCT TTG TGA CTG CCG GGC TTG ACG CGG ACG ACC ACA GAG
gly pro thr ser thr arg gly pro leu)OPA(leu pro gly leu thr arg thr thr thr glu
482/161                 SEQ ID NO:  234     512/171
TCG GTC ATC GCC TAA GGC TAC CGT TCT GAC CTG GGG CTG CGT GGG CGC CGA CGA CGT GAG
ser val ile ala)OCH(gly tyr arg ser asp leu gly leu arg gly arg arg arg arg glu
542/181                SEQ ID NO:  235      572/191
GCA CGT CAT GTC TCA GCG GCC CAC CGC CAC CTC GGT CGC CGG CAG TAT GTC AGC ATG TGC
ala arg his val ser ala ala his arg his leu gly arg arg gln tyr val ser met cys
602/201                                     632/211
AGA TGA CTC CAC GCA GCC TTG TTC GCA TCG TTG GTG TCG TGG TTG CGA CGA CCT TGG CGC
arg)OPA(leu his ala ala leu phe ala ser leu val ser trp leu arg arg pro trp arg
662/221     SEQ ID NO:  236                 692/231
TGG TGA GCG CAC CCG CCG GCG GTC GTG CCG CGC ATG CGG ATC
trp)OPA(ala his pro pro ala val val pro arg met arg ile)
         SEQ ID NO:  237
```

SEQ ID NOS:228-237

FIG. 13B

```
         ┌─SEQ ID NO: 238                      33/11
GAT TTC GTT GCC CGA TGG ATT GTT TGT ACG GTT TGG GAA AAA CAC TTG AAG TCC TTT TTA
(asp phe val ala arg trp ile val cys thr val trp glu lys his leu lys ser phe leu
63/21    ┌─SEQ ID NO: 239                     93/31
TTG GCA ATG CTG GAA ATG GAC ATT CCA ATA TTG CGC GAA TTA ACC GAA CAC GGT GAG GGG
leu ala met leu glu met asp ile pro ile leu arg glu leu thr glu his gly glu gly
123/41                                       153/51
GGG GCA AGC GTT TGT ACC GGG GCC AGC AAG CGC CGC CGA CCG GTT GAC CGA AGC CAG CAT
gly ala ser val cys thr gly ala ser lys arg arg arg pro val asp arg ser gln his
183/61                                       213/71
GTT GTT GTG TCA GCG CGG GCT TGG TCT CGA TGT CCC GGC CTT GGC TGG ACC CGC TTC TTC
val val val ser ala arg ala trp ser arg cys pro gly leu gly trp thr arg phe phe
243/81                                       273/91
AAA ACA GGT TGA ACT TAA CGA CTC AAG AAC GGA AAC GCT TGA ACC GCG ACG TCG CTC CGG
lys thr gly)OPA thr OCH(arg leu lys asn gly asn ala)OPA(thr ala thr ser leu arg
303/101 SEQ ID NO: 240                       333/111         ┌─SEQ ID NO: 241
ACA CCA ATT TGA CTC GGC TCT TTG GCA ATT GAA GGT GAG CTG CGA GCA GCC GGG TGA CCG
thr pro ile)OPA(leu gly ser leu ala ile glu gly glu leu arg ala ala gly)OPA(pro
363/121       └─SEQ ID NO: 242               393/131         SEQ ID NO: 243 ─┐
CAT CGT TGG CCT TGC CAT CAA TCG CCG GCT CGC GGA CGT AGA TAA TCA GCT CAC CGT TGG
his arg trp pro cys his gln ser pro ala arg gly arg arg)OCH(ser ala his arg trp
423/141                                      453/151           ┌─SEQ ID NO: 244
GAC CGA CCT CGA CCA GGG GTC CTT TGT GAC TGC CGG GCT TGA CGC GGA CGA CCA CAG AGT
asp arg pro arg pro gly val leu cys asp cys arg ala)OPA(arg gly arg pro gln ser
483/161                                      513/171           ┌─SEQ ID NO: 245
CGG TCA TCG CCT AAG GCT ACC GTT CTG ACC TGG GGC TGC GTG GGC GCC GAC GAC GTG AGG
arg ser pro lys ala thr val leu thr trp gly cys val gly ala asp asp val arg
543/181                                      573/191
CAC GTC ATG TCT CAG CGG CCC ACC GCC ACC TCG GTC GCC GGC AGT ATG TCA GCA TGT GCA
his val met ser gln arg pro thr ala thr ser val ala gly ser met ser ala cys ala
603/201                                      633/211
GAT GAC TCC ACG CAG CCT TGT TCG CAT CGT TGG TGT CGT GGT TGC GAC GAC CTT GGC GCT
asp asp ser thr gln pro cys ser his arg trp cys arg gly cys asp asp leu gly ala
663/221                                      693/231
GGT GAG CGC ACC CGC CGG CGG TCG TGC CGC GCA TGC GGA TC
gly glu arg thr arg arg arg ser cys arg ala cys gly)
```

SEQ ID NOS:238-245

FIG. 13C part of the nucleotide sequence of seq13A
```
1/1    SEQ ID NO: 246                      31/11
GGG TCC TTT GTG ACT GCC GGG CTT GAC GCG GAC GAC CAC AGA GTC GGT CAT CGC CTA AGG
(gly ser phe val thr ala gly leu asp ala asp asp his arg val gly his arg leu arg
61/21   SEQ ID NO: 247                     91/31
CTA CCG TTC TGA CCT GGG GCT GCG TGG GCG CCG ACG ACG TGA GGC ACG TCA TGT CTC AGC
leu pro phe)OPA(pro gly ala ala trp ala pro thr thr)OPA(gly thr ser cys leu ser
121/41            SEQ ID NO: 248           151/51            SEQ ID NO: 249
GGC CCA CCG CCA CCT CGG TCG CCG GCA GTA TGT CAG CAT GTG CAG ATG ACT CCA CGC AGC
gly pro pro pro pro arg ser pro ala val cys gln his val gln met thr pro arg ser
181/61                                     211/71
CTT GTT CGC ATC GTT GGT GTC GTG GTT GCG ACG ACC TTG GCG CTG GTG AGC GCA CCC GCC
leu val arg ile val gly val val val ala thr thr leu ala leu val ser ala pro ala
241/81
GGC GGT CGT GCC GCG CAT GCG GAT C
gly gly arg ala ala his ala asp)
```

SEQ ID NOS:246-249

FIG. 13A'

```
1/1   SEQ ID NO: 250                       31/11
GGT CCT TTG TGA CTG CCG GGC TTG ACG CGG ACG ACC ACA GAG TCG GTC ATC GCC TAA GGC
gly pro(leu OPA leu pro gly leu thr arg thr thr thr glu ser val ile ala)OCH(gly
61/21   SEQ ID NO: 251                     91/31             SEQ ID NO: 252
TAC CGT TCT GAC CTG GGC TGC GTG GGC GCC GAC GAC GTG AGG CAC GTC ATG TCT CAG CGG
tyr arg ser asp leu gly leu arg gly arg arg arg glu ala arg his val ser ala
121/41                                     151/51
GCC CAC CGC CAC CTC GGT CGC CGG CAG TAT GTC AGC ATG TGC AGA TGA CTC CAC GCA GCC
ala his arg his leu gly arg arg gln tyr val ser met cys arg)OPA(leu his ala ala
181/61                                     211/71              SEQ ID NO: 253
TTG TTC GCA TCG TTG GTG TCG TGG TTG CGA CGA CCT TGG CGC TGG TGA GCG CAC CCG CCG
leu phe ala ser leu val ser trp leu arg arg pro trp arg trp)OPA(ala his pro pro
241/81                                                        SEQ ID NO: 254
GCG GTC GTG CCG CGC ATG CGG ATC
ala val val pro arg met arg ile)
```

SEQ ID NOS:250-254

FIG. 13B'

```
1/1   SEQ ID NO: 255                       31/11
GTC CTT TGT GAC TGC CGG GCT TGA CGC GGA CGA CCA CAG AGT CGG TCA TCG CCT AAG GCT
(val leu cys asp cys arg ala)OPA(arg gly arg pro gln ser arg ser ser pro lys ala
61/21    SEQ ID NO: 256                    91/31   SEQ ID NO: 257
ACC GTT CTG ACC TGG GCT GCG TGG GCG CCG ACG ACG TGA GGC ACG TCA TGT CTC AGC GG
thr val leu thr trp gly cys val gly ala asp asp val arg his val met ser gln arg
121/41                                     151/51
CCC ACC GCC ACC TCG GTC GCC GGC AGT ATG TCA GCA TGT GCA GAT GAC TCC ACG CAG CCT
pro thr ala thr ser val ala gly ser met ser ala cys ala asp asp ser thr gln pro
181/61                                     211/71
TGT TCG CAT CGT TGG TGT CGT GGT TGC GAC GAC CTT GGC GCT GGT GAG CGC ACC CGC CGG
cys ser his arg trp cys arg gly cys asp asp leu gly ala gly glu arg thr arg arg
241/81
CGG TCG TGC CGC GCA TGC GGA TC
arg ser cys arg ala cys gly)
```

SEQ ID NOS:255-257

FIG. 13C' sequence Rv1984c predicted by Cole et al. (Nature 393:537-544) and
containing seq13A'

```
1/1    SEQ ID NO: 258                    31/11
atg act cca cgc agc ctt gtt cgc atc gtt ggt gtc gtg gtt gcg acg acc ttg gcg ctg
(Met thr pro arg ser leu val arg ile val gly val val val ala thr thr leu ala leu
61/21  SEQ ID NO: 259                    91/31
gtg agc gca ccc gcc ggc ggt cgt gcc gcg cat gcg gat ccg tgt tcg gac atc gcg gtc
val ser ala pro ala gly gly arg ala ala his ala asp pro cys ser asp ile ala val
121/41                                   151/51
gtt ttc gct cgc ggc acg cat cag gct tct ggt ctt ggc gac gtc ggt gag gcg ttc gtc
val phe ala arg gly thr his gln ala ser gly leu gly asp val gly glu ala phe val
181/61                                   211/71
gac tcg ctt acc tcg caa gtt ggc ggg cgg tcg att ggg gtc tac gcg gtg aac tac cca
asp ser leu thr ser gln val gly gly arg ser ile gly val tyr ala val asn tyr pro
241/81                                   271/91
gca agc gac gac tac cgc gcg agc gcg tca aac ggt tcc gat gat gcg agc gcc cac atc
ala ser asp asp tyr arg ala ser ala ser asn gly ser asp asp ala ser ala his ile
301/101                                  331/111
cag cgc acc gtc gcc agc tgc ccg aac acc agg att gtg ctt ggt ggc tat tcg cag ggt
gln arg thr val ala ser cys pro asn thr arg ile val leu gly gly tyr ser gln gly
361/121                                  391/131
gcg acg gtc atc gat ttg tcc acc tcg gcg atg ccg ccc gcg gtg gca gat cat gtc gcc
ala thr val ile asp leu ser thr ser ala met pro pro ala val ala asp his val ala
421/141                                  451/151
gct gtc gcc ctt ttc ggc gag cca tcc agt ggt ttc tcc agc atg ttg tgg ggc ggc ggg
ala val ala leu phe gly glu pro ser ser gly phe ser ser met leu trp gly gly gly
481/161                                  511/171
tcg ttg ccg aca atc ggt ccg ctg tat agc tct aag acc ata aac ttg tgt gct ccc gac
ser leu pro thr ile gly pro leu tyr ser ser lys thr ile asn leu cys ala pro asp
541/181                                  571/191
gat cca ata tgc acc gga ggc ggc aat att atg gcg cat gtt tcg tat gtt cag tcg ggg
asp pro ile cys thr gly gly gly asn ile met ala his val ser tyr val gln ser gly
601/201                                  631/211
atg aca agc cag gcg gcg aca ttc gcg gcg aac agg ctc gat cac gcc gga tga
met thr ser gln ala ala thr phe ala ala asn arg leu asp his ala gly)OPA
```

SEQ ID NOS:258-259

FIG. 13D

Seq13F: ORF predicted by Cole et al. (Nature 393:537-544) and containing Rv1984c

```
1/1    SEQ ID NO: 260                    31/11
tga ggc acg tca tgt ctc agc ggc cca ccg cca cct cgg tcg ccg gca gta tgt cag cat
OPA(gly thr ser cys leu ser gly pro pro pro pro arg ser pro ala val cys gln his
61/21   SEQ ID NO: 261                   91/31
gtg cag atg act cca cgc agc ctt gtt cgc atc gtt ggt gtc gtg gtt gcg acg acc ttg
val gln met thr pro arg ser leu val arg ile val gly val val val ala thr thr leu
121/41                                   151/51
gcg ctg gtg agc gca ccc gcc ggc ggt cgt gcc gcg cat gcg gat ccg tgt tcg gac atc
ala leu val ser ala pro ala gly gly arg ala ala his ala asp pro cys ser asp ile
181/61                                   211/71
gcg gtc gtt ttc gct cgc ggc acg cat cag gct tct ggt ctt ggc gac gtc ggt gag gcg
ala val val phe ala arg gly thr his gln ala ser gly leu gly asp val gly glu ala
241/81                                   271/91
ttc gtc gac tcg ctt acc tcg caa gtt ggc ggg cgg tcg att ggg gtc tac gcg gtg aac
phe val asp ser leu thr ser gln val gly gly arg ser ile gly val tyr ala val asn
301/101                                  331/111
tac cca gca agc gac gac tac cgc gcg agc gcg tca aac ggt tcc gat gat gcg agc gcc
tyr pro ala ser asp asp tyr arg ala ser ala ser asn gly ser asp asp ala ser ala
361/121                                  391/131
cac atc cag cgc acc gtc gcc agc tgc ccg aac acc agg att gtg ctt ggt ggc tat tcg
his ile gln arg thr val ala ser cys pro asn thr arg ile val leu gly gly tyr ser
421/141                                  451/151
cag ggt gcg acg gtc atc gat ttg tcc acc tcg gcg atg ccg ccc gcg gtg gca gat cat
gln gly ala thr val ile asp leu ser thr ser ala met pro pro ala val ala asp his
481/161                                  511/171
gtc gcc gct gtc gcc ctt ttc ggc gag cca tcc agt ggt ttc tcc agc atg ctg tgg ggc
val ala ala val ala leu phe gly glu pro ser ser gly phe ser ser met leu trp gly
541/181                                  571/191
ggc ggg tcg ttg ccg aca atc ggt ccg ctg tat agc tct aag acc ata aac ttg tgt gct
gly gly ser leu pro thr ile gly pro leu tyr ser ser lys thr ile asn leu cys ala
601/201                                  631/211
ccc gac gat cca ata tgc acc gga ggc ggc aat att atg gcg cat gtt tcg tat gtt cag
pro asp asp pro ile cys thr gly gly gly asn ile met ala his val ser tyr val gln
661/221                                  691/231
tcg ggg atg aca agc cag gcg gcg aca ttc gcg gcg aac agg ctc gat cac gcc gga tga
ser gly met thr ser gln ala ala thr phe ala ala asn arg leu asp his ala gly)OPA
```

SEQ ID NOS:260-261

FIG. 13E

```
                SEQ ID NO: 262                      31/11
CCA CCG GGG CTG GAG GGG CGA ATG TGC GCC GAA CGC CGT CGG CCA ACT TGG CCG CTG AGG
(pro pro gly leu glu gly arg met cys ala glu arg arg arg pro thr trp pro leu arg
 61/21    SEQ ID NO: 263                             91/31
GCG GCT GAT CCC CTG GCC CGA GAC GGG GCA AGC CAA TAG CGG CTC CAT CGG GCT TTG CTG
ala ala asp pro leu ala arg asp gly ala ser gln)AMB(arg leu his arg ala leu leu
121/41                                151/51         SEQ ID NO: 264
GTA GCG GTT CGG CGG GAA CCG AGC GCC GAC GTT GTC GGT GCC CGG TGA TAT ATT GGG TCA
val ala val arg arg glu pro ser ala asp val val gly ala arg)OPA(tyr ile gly ser
181/61                                  211/71              SEQ ID NO: 265
GAC GGG TAT GGC GGC GAC TGA GGT GAT CTG CGA CAC GCC GCC GCG GTG CTC GAG CCA GGC
asp gly tyr gly gly asp)OPA(gly asp leu arg his ala ala ala val leu glu pro gly
241/81      SEQ ID NO: 266              271/91
TTA CGA CCA GGG AAT TTC GAA AAT GTT ATT CAG AAC ATC TTG TAT CTC TTC CTC CGT GCC
leu arg pro gly asn phe glu asn val ile gln asn ile leu tyr leu phe leu arg ala
301/101                                 331/111
ACC CCC TAG GTG TAG TGT TTT CGA GTA CCG GCA GAT CCC AGT TCA CCA GTC TCA CCA GAT
thr pro)AMB val AMB(cys phe arg val pro ala asp pro ser ser pro val ser pro asp)
                    SEQ ID NO: 267
C
```

SEQ ID NOS:262-267

FIG. 14A

```
                SEQ ID NO: 268                      32/11
CAC CGG GGC TGG AGG GGG GAA TGT GCG CCG AAC GCC GTC GGC CAA CTT GGC CGC TGA GGG
(his arg gly trp arg gly glu cys ala pro asn ala val gly gln leu gly arg)OPA(gly
 62/21      SEQ ID NO: 269               92/31             SEQ ID NO: 270
CGG CTG ATC CCC TGG CCC GAG ACG GGG CAA GCC AAT AGC GGC TCC ATC GGG CTT TGC TGG
arg leu ile pro trp pro glu thr gly gln ala asn ser gly ser ile gly leu cys trp)
122/41                                152/51
TAG CGG TTC GGC GGG AAC CGA GCG CCG ACG TTG TCG GTG CCC GGT GAT ATA TTG GTC AG
AMB(arg phe gly gly asn arg ala pro thr leu ser val pro gly asp ile leu gly gln
182/61     SEQ ID NO: 271               212/71
ACG GGT ATG GCG GCG ACT GAG GTG ATC TGC GAC ACG CCG CCG CGG TGC TCG AGC CAG GCT
thr gly met ala ala thr glu val ile cys asp thr pro pro arg cys ser ser gln ala
242/81                                  272/91
TAC GAC CAG GGA ATT TCG AAA ATG TTA TTC AGA ACA TCT TGT ATC TCT TCC TCC GTG CCA
tyr asp gln gly ile ser lys met leu phe arg thr ser cys ile ser ser ser val pro
302/101                                 332/111
CCC CCT AGG TGT AGT GTT TTC GAG TAC CGG CAG ATC CCA GTT CAC CAG TCT CAC CAG ATC
pro pro arg cys ser val phe glu tyr arg gln ile pro val his gln ser his gln ile)
```

SEQ ID NOS:268-271

FIG. 14B

```
   SEQ ID NO: 274                          33/11
ACC GGG GCT GGA GGG GCG AAT GTG CGC CGA ACG CCG TCG GCC AAC TTG GCC GCT GAG GGC
(thr gly ala gly gly ala asn val arg arg thr pro ser ala asn leu ala ala glu gly
63/21    SEQ ID NO: 275                    93/31
GGC TGA TCC CCT GGC CCG AGA CGG GGC AAG CCA ATA GCG GCT CCA TCG GGC TTT GCT GGT
gly)OPA(ser pro gly pro arg arg gly lys pro ile ala ala pro ser gly phe ala gly
123/41     SEQ ID NO: 276                  153/51
AGC GGT TCG GCG GGA ACC GAG CGC CGA CGT TGT CGG TGC CCG GTG ATA TAT TGG GTC AGA
ser gly ser ala gly thr glu arg arg arg cys arg cys pro val ile tyr trp val arg
183/61                                     213/71
CGG GTA TGG CGG CGA CTG AGG TGA TCT GCG ACA CGC CGC CGC GGT GCT CGA GCC AGG CTT
arg val trp arg arg leu arg)OPA(ser ala thr arg arg arg gly ala arg ala arg leu
243/81            SEQ ID NO: 277           273/91
ACG ACC AGG GAA TTT CGA AAA TGT TAT TCA GAA CAT CTT GTA TCT CTT CCT CCG TGC CAC
thr thr arg glu phe arg lys cys tyr ser glu his leu val ser leu pro pro cys his
303/101                                    333/111
CCC CTA GGT GTA GTG TTT TCG AGT ACC GGC AGA TCC CAG TTC ACC AGT CTC ACC AGA TC
pro leu gly val val phe ser ser thr gly arg ser gln phe thr ser leu thr arg)
```

SEQ ID NOS:274-277

FIG. 14C part of the nucleotide sequence of seq14A

```
1/1   SEQ ID NO: 278                      31/11
TTT TCG AGT ACC GGC AGA TCC CAG GTT CAC CAG GTC TCA CCA GAT C
phe ser ser thr gly arg ser gln val his gln val ser pro asp
    SEQ ID NO: 279
```

SEQ ID NOS:278-279

FIG. 14A'

```
1/1   SEQ ID NO: 280                      31/11
TGT TTT CGA GTA CCG GCA GAT CCC AGG TTC ACC AGG TCT CAC CAG ATC
cys phe arg val pro ala asp pro arg phe thr arg ser his gln ile
    SEQ ID NO: 281
```

SEQ ID NOS:280-281

FIG. 14B'

```
1/1   SEQ ID NO: 282                      31/11
GTT TTC GAG TAC CGG CAG ATC CCA GGT TCA CCA GGT CTC ACC AGA TC
val phe glu tyr arg gln ile pro gly ser pro gly leu thr arg
    SEQ ID NO: 283
```

SEQ ID NOS:282-283

FIG. 14C'

ORF predicted based on the sequence       published by Cole et al.
(Nature 393:537-544) and containing seq14A·

1/1 ── SEQ ID NO: 284                    31/11
TAG CGG TTC GGC GGG AAG CTA GCG GCG ACG TTG TCG GTG GCC GGT GAT ATA TTG GGT CAG
AMB(arg phe gly gly lys leu ala ala thr leu ser val ala gly asp ile leu gly gln
61/21 ── SEQ ID NO: 285                  91/31
ACG GGT ATG GCG GCG GCT GAG GTG ATC TGC GAC ACG CCG CCG CGG TGC TCG AGC CAG GCT
thr gly met ala ala ala glu val ile cys asp thr pro pro arg cys ser ser gln ala
121/41                                   151/51
TAC GAC CAG GGA ATT TCG AAA ATG TTA TTC AGA ACA TCT TGT ATC TCT TCT CCG TGC CAC
tyr asp gln gly ile ser lys met leu phe arg thr ser cys ile ser ser pro cys his
181/61                                   211/71
CCC CTA GGT GTA GTG TTT TCG AGT ACC GGC AGA TCC CAG GTT CAC CAG GTC TCA CCA gat
pro leu gly val val phe ser ser thr gly arg ser gln val his gln val ser pro asp
241/81                                   271/91
cca cgg ggc gcg atg aac ttc ccg gca tcg gca tcg cca ggt cga cgg acg tgg tcg cgc
pro arg gly ala met asn phe pro ala ser ala ser pro gly arg arg thr trp ser arg
301/101                                  331/111
tat gac ggg aat ctg gag cct tgt cgg gcc gct caa cat atc gaa gat gca cta ctt gag
tyr asp gly asn leu glu pro cys arg ala ala gln his ile glu asp ala leu leu glu
361/121                                  391/131
tcg ttg cca gat cct gtc aga ttc ccg att tcc gca aag gag cgg tac gcc cat gac cgt
ser leu pro asp pro val arg phe pro ile ser ala lys glu arg tyr ala his asp arg
421/141
gac cgt tta cac taa
asp arg leu his)OCH

SEQ ID NOS:284-285

FIG. 14D

Sequence Rv3054c predicted by Cole et al. (Nature 393:537-544)
which may be in phase with Seq14A'

```
1/1    SEQ ID NO: 286                    31/11
gtg tca gat acc aag tcc gac atc aaa atc ttg gcc tta gtg gga agc ctg cgc gcg gcg
(val ser asp thr lys ser asp ile lys ile leu ala leu val gly ser leu arg ala ala
61/21   SEQ ID NO: 287                   91/31
tcg ttc aac cgc cag atc gcc gag ctg gct gcc aag gtc gct ccg gac ggc gtc acc gtc
ser phe asn arg gln ile ala glu leu ala ala lys val ala pro asp gly val thr val
121/41                                   151/51
acc atg ttc gag ggg ctg ggg gac ctg ccg ttc tac aac gaa gac atc gac aca gcg acg
thr met phe glu gly leu gly asp leu pro phe tyr asn glu asp ile asp thr ala thr
181/61                                   211/71
gag gtg ccg gcg ccg gtg agc gcg ttg cgg gag gcc gcg tct gac gcg cac gct gcc ttg
glu val pro ala pro val ser ala leu arg glu ala ala ser asp ala his ala ala leu
241/81                                   271/91
gtg gtc acg ccg gaa tac aac ggc agc att ccg gcc gtg atc aag aac gcg atc gac tgg
val val thr pro glu tyr asn gly ser ile pro ala val ile lys asn ala ile asp trp
301/101                                  331/111
ctg tcc agg cca ttc ggc gat ggc gcg ttg aag gac aag ccg ttg gcc gtg atc ggc ggc
leu ser arg pro phe gly asp gly ala leu lys asp lys pro leu ala val ile gly gly
361/121                                  391/131
tcc atg ggc cgc tac ggc ggg gta tgg gcg cac gac gag act cgc aag tcg ttc agc atc
ser met gly arg tyr gly gly val trp ala his asp glu thr arg lys ser phe ser ile
421/141                                  451/151
gct ggc acg cgg gtg gtc gat gcg atc aaa ctg tcg gtg ccg ttc caa act ctg ggc aag
ala gly thr arg val val asp ala ile lys leu ser val pro phe gln thr leu gly lys
481/161                                  511/171
tcg gtc gcg gac gac gcc ggg ctg gcg gcg aat gtg cgc gac gcc gtc ggc aac ttg gcc
ser val ala asp asp ala gly leu ala ala asn val arg asp ala val gly asn leu ala
541/181
gct gag gtc ggc tga
ala glu val gly)OPA
```

SEQ ID NOS:286-287

FIG. 14E

ORF predicted by Cole et al. (Nature 393:537-544) and containing Rv3054c

1/1 SEQ ID NO: 288                                      31/11
taa cgc gat cgg aat aaa tcg gac cat ggt ccg gtt ggc tcg tgc aag gac gtg gac caa
OCH(arg asp arg asn lys ser asp his gly pro val gly ser cys lys asp val asp gln
61/21 SEQ ID NO: 289                                    91/31
caa gcg gaa agg aac gta gca gtg tca gat acc aag tcc gac atc aaa atc ttg gcc tta
gln ala glu arg asn val ala val ser asp thr lys ser asp ile lys ile leu ala leu
121/41                                                  151/51
gtg gga agc ctg cgc gcg gcg tcg ttc aac cgc cag atc gcc gag ctg gct gcc aag gtc
val gly ser leu arg ala ala ser phe asn arg gln ile ala glu leu ala ala lys val
181/61                                                  211/71
gct ccg gac ggc gtc acc gtc acc atg ttc gag ggg ctg ggg gac ctg ccg ttc tac aac
ala pro asp gly val thr val thr met phe glu gly leu gly asp leu pro phe tyr asn
241/81                                                  271/91
gaa gac atc gac aca gcg acg gag gtg ccg gcg ccg gtg agc gcg ttg cgg gag gcc gcg
glu asp ile asp thr ala thr glu val pro ala pro val ser ala leu arg glu ala ala
301/101                                                 331/111
tct gac gcg cac gct gcc ttg gtg gtc acg ccg gaa tac aac ggc agc att ccg gcc gtg
ser asp ala his ala ala leu val val thr pro glu tyr asn gly ser ile pro ala val
361/121                                                 391/131
atc aag aac gcg atc gac tgg ctg tcc agg cca ttc ggc gat ggc gcg ttg aag gac aag
ile lys asn ala ile asp trp leu ser arg pro phe gly asp gly ala leu lys asp lys
421/141                                                 451/151
ccg ttg gcc gtg atc ggc ggc tcc atg ggc cgc tac ggc ggg gta tgg gcg cac gac gag
pro leu ala val ile gly gly ser met gly arg tyr gly gly val trp ala his asp glu
481/161                                                 511/171
act cgc aag tcg ttc agc atc gct ggc acg cgg gtg gtc gat gcg atc aaa ctg tcg gtg
thr arg lys ser phe ser ile ala gly thr arg val val asp ala ile lys leu ser val
541/181                                                 571/191
ccg ttc caa act ctg ggc aag tcg gtc gcg gac gac gcc ggg ctg gcg gcg aat gtg cgc
pro phe gln thr leu gly lys ser val ala asp asp ala gly leu ala ala asn val arg
601/201                                                 631/211
gac gcc gtc ggc aac ttg gcc gct gag gtc ggc tga
asp ala val gly asn leu ala ala glu val gly)OPA

SEQ ID NOS:288-289

FIG. 14F

SEQ ID NO: 290: first frame nucleic acid
SEQ ID NO: 297: second frame nucleic acid
SEQ ID NO: 310: third frame nucleic acid
fragment based on the sequence published by Cole et al. (Nature 393:537-544)
and containing seq 14F' and seq 14P'   SEQ ID NO: 291
1/1  SEQ ID NO: 290,297,310              31/11
taa cgc gat cgg aat aaa tcg/gac cat ggt ccg gtt ggc tcg tgc aag gac gtg gac caa
OCH(arg asp arg asn lys ser asp his gly pro val gly ser cys lys asp val asp gln
(asn ala ile gly ile asn arg thr met val arg leu ala arg ala arg thr trp thr asn
 (thr arg ser glu)OCH(ile\gly pro trp ser gly trp leu val gln gly arg gly pro thr
61/21  SEQ ID NO:  298    SEQ ID NO: 311 91/31 SEQ ID NO: 312
caa gcg gaa agg aac gta gca gtg tca gat acc aag tcc gac atc aaa atc ttg gcc tta
gln ala glu arg asn val ala val ser asp thr lys ser asp ile lys ile leu ala leu
 lys arg lys gly thr)AMB(gln cys gln ile pro ser pro thr ser lys ser trp pro)AMB
   ser gly lys glu arg ser)ser val arg tyr gln val arg his gln asn leu gly leu ser
121/41    SEQ ID NO: 299              151/51
gtg gga agc ctg cgc gcg gcg tcg ttc aac cgc cag atc gcc gag ctg gct gcc aag gtc
val gly ser leu arg ala ala ser phe asn arg gln ile ala glu leu ala ala lys val
(trp glu ala cys ala arg arg arg ser thr ala arg ser pro ser trp leu pro arg ser
  gly\lys pro ala arg gly val val gln pro pro asp arg arg ala gly cys gln gly arg
181/61   SEQ ID NO: 300             211/71
gct ccg gac ggc gtc acc gtc acc atg ttc gag ggg ctg ggg gac ctg ccg ttc tac aac
ala pro asp gly val thr val thr met phe glu gly leu gly asp leu pro phe tyr asn
 leu arg thr ala ser pro ser pro cys ser arg gly trp gly thr cys arg ser thr thr
   ser gly arg arg his arg his his val arg gly ala gly gly pro ala val leu gln arg
241/81                              271/91
gaa gac atc gac aca gcg acg gag gtg ccg gcg ccg gtg agc gcg ttg cgg gag gcc gcg
glu asp ile asp thr ala thr glu val pro ala val ser ala leu arg glu ala ala
 lys thr ser thr gln arg arg arg cys arg arg arg)OPA(ala arg cys gly arg pro arg
   arg his arg his ser asp gly gly ala gly ala gly glu\arg val ala gly gly arg val)
301/101                              331/111           SEQ ID NO: 301
tct gac gcg cac gct gcc ttg gtg gtc acg ccg gaa tac aac ggc agc att ccg gcc gtg
ser asp ala his ala ala leu val val thr pro glu tyr asn gly ser ile pro ala val
 leu thr arg thr leu pro trp trp ser arg arg asn thr thr ala ala phe arg pro OPA
  OPA(arg ala arg cys leu gly gly his ala gly ile gln arg gln his ser gly arg asp
361/121  SEQ ID NO: 313              391/131
atc aag aac gcg atc gac tgg ctg tcc agg cca ttc ggc gat ggc gcg ttg aag gac aag
ile lys asn ala ile asp trp leu ser arg pro phe gly asp gly ala leu lys asp lys
(ser arg thr arg ser thr gly cys pro gly his ser ala met ala arg)OPA(arg thr ser
  gln\glu arg asp arg leu ala val gln ala ile arg arg trp arg val glu)gly gln ala
421/141  SEQ ID NO: 302              451/151            SEQ ID NO: 303
ccg ttg gcc gtg atc ggc ggc tcc atg ggc cgc tac ggc ggg gta tgg gcg cac gac gag
pro leu ala val ile gly gly ser met gly arg tyr gly val trp ala his asp glu
 arg trp pro)OPA(ser ala ala pro trp ala ala thr ala gly tyr gly arg thr thr arg
   val gly arg asp\arg arg leu his gly pro leu arg arg gly met gly ala arg arg asp
481/161              SEQ ID NO: 304     511/171
act cgc aag tcg ttc agc atc gct ggc acg gtg gtc gat gcg atc aaa ctg tcg gtg
thr arg lys ser phe ser ile ala gly thr val val asp ala ile lys leu ser val
 leu ala ser arg ser ala ser leu ala arg gly trp ser met arg ser asn cys arg cys
   ser gln val val gln his arg trp his ala gly gly arg cys asp gln thr val gly ala
541/181                              571/191
ccg ttc caa act ctg ggc aag tcg gtc gcg gac gac gcc ggg ctg gcg gcg aat gtg cgc
pro phe gln thr leu gly lys ser val ala asp asp ala gly leu ala ala asn val arg
 arg ser lys leu trp ala ser arg ser arg thr thr pro gly trp arg arg met cys ala
   val pro asn ser gly gln val gly arg gly arg arg ala gly gly glu cys ala arg
601/201                              631/211   SEQ ID NO: 292
gac gcc gtc ggc aac ttg gcc gct gag gtc ggc tga(tcc ctg gca ggc cga ggc ggg tca gcc
asp ala val gly asn leu ala ala glu val gly)OPA(ser leu gly arg gly gly ser ala
 thr pro ser ala thr trp pro leu arg ser ala asp pro trp ala glu ala gly gln pro
   arg arg arg gln leu gly arg)OPA(gly arg leu ile pro gly pro arg arg val ser gln)
661/221           SEQ ID NO: 314       691/231            SEQ ID NO: 293
aat agc ggc tcc atc ggc ttt gct ggt agc ggt tcg gcg gga agc\tag(cgg cga cgt tgt
asn ser gly ser ile gly phe ala gly ser gly ser ala gly ser)AMB(arg arg arg cys
 ile ala ala pro ser ala leu leu val ala val arg arg glu ala ser gly asp val val
   AMB(arg leu his arg leu cys trp)AMB(arg phe gly gly lys leu ala ala thr leu ser
        SEQ ID NO: 315                 SEQ ID NO: 316

SEQ ID NOS:290-316

FIG. 14G

```
721/241                              751/251      SEQ ID NO: 294
cgg tgg ccg gtg ata tat tgg gtc aga cgg gta tgg cgg cgg ctg agg tga tct gcg aca
arg trp pro val ile tyr trp val arg arg val trp arg arg leu arg)OPA(ser ala thr
 gly gly arg)OPA(tyr ile gly ser asp gly tyr gly gly gly)OPA(gly asp leu arg his
   val ala gly/asp ile leu gly gln thr gly met ala ala ala/glu val ile cys asp thr
781/261       SEQ ID NO: 305        811/271       SEQ ID NO: 306
cgc cgc cgc ggt gct cga gcc agg ctt acg acc agg gaa ttt cga aaa tgt tat tca gaa
arg arg arg gly ala arg ala arg leu thr arg glu phe arg lys cys tyr ser glu
 ala ala ala val leu glu pro gly leu arg pro gly asn phe glu asn val ile gln asn
   pro pro arg cys ser ser gln ala tyr asp gln gly ile ser lys met leu phe arg thr
841/281                              871/291         SEQ ID NO: 295
cat ctt gta tct ctt ctc cgt gcc acc ccc tag gtg tag tgt ttt cga gta ccg gca gat
his leu val ser leu leu arg ala thr pro)AMB val AMB(cys phe arg val pro ala asp
 ile leu tyr leu phe ser val pro pro arg cys ser val phe glu tyr arg gln ile
   ser cys ile ser ser pro cys his pro leu gly val val phe ser ser thr gly arg ser
901/301                              931/311         SEQ ID NO: 296
ccc agg ttc acc agg tct cac cag atc cac ggg gcg cga tga act tcc cgg cat cgg cat
pro arg phe thr arg ser his gln ile his gly ala arg)OPA(thr ser arg his arg his
 pro gly ser pro gly leu thr arg ser gly arg asp glu leu pro gly ile gly ile
   gln val his gln val ser pro asp pro arg gly ala met asn phe pro ala ser ala ser
961/321                              991/331
cgc cag gtc gac gga cgt ggt cgc gct atg acg gga atc tgg agc ctt gtc ggg ccg ctc
arg gln val asp gly arg gly arg ala met thr gly ile trp ser leu val gly pro leu
 ala arg ser thr asp val val ala leu)OPA(arg glu ser gly ala leu ser gly arg ser
   pro gly arg arg thr trp ser arg tyr/asp gly asn leu glu pro cys arg ala ala gln
1021/341      SEQ ID NO: 307         1051/351
aac ata tcg aag atg cac tac ttg agt cgt tgc cag atc ctg tca gat tcc cga ttt ccg
asn ile ser lys met his tyr leu ser arg cys gln ile leu ser asp ser arg phe pro
 thr tyr arg arg cys thr thr)OPA(val val ala arg ser cys gln ile pro asp phe arg
   his ile glu asp ala leu leu/glu ser leu pro asp pro val arg phe pro ile ser ala
1081/361       SEQ ID NO: 308        1111/371
caa agg agc ggt acg ccc atg acc gtg acc gtt tac act aa)
gln arg ser gly thr pro met thr val thr val tyr thr)
 lys gly ala val arg pro)OPA pro OPA(pro phe thr leu
   lys glu arg tyr ala his asp arg asp)arg leu his)OCH
           SEQ ID NO: 309
```

SEQ ID NOS:290-316

FIG. 14G(continued)

```
1/1    SEQ ID NO: 317                 31/11
CAA GCC CGG CCG CGA CTG TTT GCC GTT TTG GGG CTC CTA CCA GAA CAC CAC CTG GCG GCC
(gln ala arg pro arg leu phe ala val leu gly leu leu pro glu his his leu ala ala
61/21     SEEQ ID NO: 318             91/31
GCG CAC CAT GGT GTG CAC CAG TTG CGA TCG GTT CCT CCC GCG CGC GGG CGG CGA CGA CGT
ala his his gly val his gln leu arg ser val pro pro ala arg gly arg arg arg arg
121/41                                151/51
CGA TGC CCG CGC CCC GGC GGC GCA GCT GCG TAG CTC GAC CCG GTC GAC GAC GAC GGG GTC
arg cys pro arg pro gly gly ala ala ala)AMB(leu asp pro val asp asp asp gly val
181/61                                211/71   SEQ ID NO: 319
GGC GGA CCA GTC GGC GAT GTC GAG GCG ATG GCA ATA CAG CGC CTT GGT GCG CGG CCA CAC
gly gly pro val gly asp val glu ala met ala ile gln arg leu gly ala arg pro his
241/81                                271/91
GTC TGA GGT GGC GAA GAC CAG TCC CGC GCC CAC CGG CAG CCG GAT CCG GAT ACG CGG TAC
val)OPA(gly gly glu asp gln ser arg ala his arg gln pro asp pro asp thr arg tyr)
     SEQ ID NO: 320
```

SEQ ID NOS:317-320

FIG. 15A

```
┌SEQ ID NO: 321                          32/11
AAG CCC GGC CGC GAC TGT TTG CCG TTT TGG GGC TCC TAC CAG AAC ACC ACC TGG CGG CCG
lys pro gly arg asp cys leu pro phe trp gly ser tyr gln asn thr thr trp arg pro
 62/21    ┌SEQ ID NO: 322                92/31
CGC ACC ATG GTG TGC ACC AGT TGC GAT CGG TTC CTC CCG CGC GCG GGC GGC GAC GAC GTC
arg thr met val cys thr ser cys asp arg phe leu pro arg ala gly gly asp asp val
122/41                                  152/51
GAT GCC CGC GCC CCG GCG GCG CAG CTG CGT AGC TCG ACC CGG TCG ACG ACG ACG GGG TCG
asp ala arg ala pro ala ala gln leu arg ser ser thr arg ser thr thr thr gly ser
182/61                                  212/71
GCG GAC CAG TCG GCG ATG TCG AGG CGA TGG CAA TAC AGC GCC TTG GTG CGC GGC CAC ACG
ala asp gln ser ala met ser arg arg trp gln tyr ser ala leu val arg gly his thr
242/81                                  272/91
TCT GAG GTG GCG AAG ACC AGT CCC GCG CCC ACC GGC AGC GGG ATC CGG ATA CGC GGT AC
ser glu val ala lys thr ser pro ala pro thr gly ser arg ile arg ile arg gly)
```

SEQ ID NOS:321-322

FIG.15B

```
┌SEQ ID NO: 323                          33/11
AGC CCG GCC GCG ACT GTT TGC CGT TTT GGG GCT CCT ACC AGA ACA CCA CCT GGC GGC CGC
ser pro ala ala thr val cys arg phe gly ala pro thr arg thr pro pro gly gly arg
 63/21    ┌SEQ ID NO: 324                93/31
GCA CCA TGG TGT GCA CCA GTT GCG ATC GGT TCC TCC CGC GCG CGG GCG GCG ACG ACG TCG
ala pro trp cys ala pro val ala ile gly ser ser arg ala arg ala ala thr thr ser
123/41                                  153/51
ATG CCC GCG CCC CGG CGG CGC AGC TGC GTA GCT CGA CCC GGT CGA CGA CGA CGG GGT CGG
met pro ala pro arg arg arg ser cys val ala arg pro gly arg arg arg gly arg
183/61                                  213/71
CGG ACC AGT CGG CGA TGT CGA GGC GAT GGA ATA CAG CGC CTT GTG CGC GCC ACA CGT
arg thr ser arg arg cys arg gly asp gly asn thr ala pro trp cys ala ala thr arg
243/81                                  273/91
CTG AGG TGG CGA AGA CCA GTC CCG CGC CCA CCG GCA GCC GGA TCC GGA TAC GCG GTA C
leu arg trp arg arg pro val pro arg pro pro ala ala gly ser gly tyr ala val)
```

SEQ ID NOS:323-324

FIG.15C part of the nucleotide sequence of seq15A

1/1 — SEQ ID NO: 325                                31/11
GGC GGC CGC GCG CCA TGG TGT GCA CCA GTT GCG ATC GGT TCT CCC GCG CGC GGG CGG CGA
gly gly arg ala pro trp cys ala pro val ala ile gly ser pro ala arg gly arg arg
61/21 — SEQ ID NO: 326                              91/31
CGA CGT CGA TGG CCG CGC CCC GGC GGC TGC AGC TGC GTA GCT CGA CCC GGT CGA CGA CGA
arg arg arg trp pro arg pro gly gly cys ser cys val ala arg pro gly arg arg arg
121/41                                              151/51
CGG GGT CGG CGG GCC AGT CGG CGA TGT CGA GGC GAT GGC AAT ACA GCG CCT TGG TGC GCG
arg gly arg arg ala ser arg arg cys arg gly asp gly asn thr ala pro trp cys ala
181/61                                              211/71
GCC ACA CGT CTG AGG TGG CGA AGA CCA GTC CCG CGC CCA CCG GCA GCC GGA TC
ala thr arg leu arg trp arg arg pro val pro arg pro pro ala ala gly

SEQ ID NOS:325-326

FIG.15A'

1/1 — SEQ ID NO: 327                                31/11
GCG GCC GCG CGC CAT GGT GTG CAC CAG TTG CGA TCG GTT CTC CCG CGC GCG GGC GGC GAC
(ala ala ala arg his gly val his gln leu arg ser val leu pro arg ala gly gly asp
61/21 — SEQ ID NO: 328                              91/31
GAC GTC GAT GGC CGC GCC CCG GCG GCT GCA GCT GCG TAG CTC GAC CCG GTC GAC GAC GAC
asp val asp gly arg ala pro ala ala ala ala ala)AMB(leu asp pro val asp asp asp
121/41                                              151/51        — SEQ ID NO: 329
GGG GTC GGC GGG CCA GTC GGC GAT GTC GAG GCG ATG GCA ATA CAG CGC CTT GGT GCG CGG
gly val gly gly pro val gly asp val glu ala met ala ile gln arg leu gly ala arg
181/61                                              211/71
CCA CAC GTC TGA GGT GGC GAA GAC CAG TCC CGC GCC CAC CGG CAG CCG GAT C
pro his val)OPA(gly gly glu asp gln ser arg ala his arg gln pro asp)
                    — SEQ ID NO: 330

SEQ ID NOS:327-330

FIG. 15B'

1/1 — SEQ ID NO: 331                                31/11
TGG CGG CCG CGC GCC ATG GTG TGC ACC AGT TGC GAT CGG TTC TCC CGC GCG CGG GCG GCG
trp arg pro arg ala met val cys thr ser cys asp arg phe ser arg ala arg ala ala
61/21 — SEQ ID NO: 332                              91/31
ACG ACG TCG ATG GCC GCG CCC GGC GGC TGC AGC TGC GTA GCT CGA CCC GGT CGA CGA CGA
thr thr ser met ala ala pro arg arg leu gln leu arg ser ser thr arg ser thr thr
121/41                                              151/51
ACG GGG TCG GCG GGC CAG TCG GCG ATG TCG AGG CGA TGG CAA TAC AGC GCC TTG GTG CGC
thr gly ser ala gly gln ser ala met ser arg arg trp gln tyr ser ala leu val arg
181/61                                              211/71
GGC CAC ACG TCT GAG GTG GCG AAG ACC AGT CCC GCG CCC ACC GGC AGC CGG ATC
gly his thr ser glu val ala lys thr ser pro ala pro thr gly ser arg ile

SEQ ID NOS:331-332

FIG. 15C'

ORF containing Seq15A' according to Cole et al. (Nature 393:537-544)

```
1/1    SEQ ID NO: 333                      31/11
taa ggt ccg cca acg ctt tac gct cga cgg ccg cca cga gtt ggc cgg cca ctt tca ggc
OCH(gly pro pro thr leu tyr ala arg arg pro pro arg val gly arg pro leu ser gly
61/21   SEQ ID NO: 334                            91/31
cgt agt cgc cgc agg gca ggg ctt ccc gcg tcg tct tcg cgg gtt tgt cgg caa agg tgt
arg ser arg arg arg ala gly leu pro ala ser ser ser arg val cys arg gln arg cys
121/41                                     151/51
agg ggt agc gtt cgt ggg cgt cga cga cga tgt gca gct cgg gga tgc cgg cgg cgc ggg
arg gly ser val arg gly arg arg arg arg cys ala ala arg gly cys arg arg arg gly
181/61                                     211/71
cgg tgg ggg tgc gca cgc ccg gcc gcg act gtt tgc gcg ttt tgg ggc tct gcc aga aca
arg trp gly cys ala arg pro ala ala thr val cys ala phe trp gly ser ala arg thr
241/81                                     271/91
cca cct ggc ggc cgc gcg cca tgg tgt gca cca gtt gcg atc ggt tct ccc gcg cgc ggg
pro pro gly gly arg ala pro trp cys ala pro val ala ile gly ser pro ala arg gly
301/101                                    331/111
cgg cga cga cgt cga tgg ccg cgc ccc ggc ggc tgc agc tgc gta gct cga ccc ggt cga
arg arg arg arg arg trp pro arg pro gly gly cys ser cys val ala arg pro gly arg
361/121                                    391/131
cga cga cgg ggt cgg cgg gcc agt cgg cga tgt cga ggc gat ggc aat aca gcg cct tgg
arg arg arg gly arg arg ala ser arg arg cys arg gly asp gly asn thr ala pro trp
421/141                                    451/151
tgc gcg gcc aca cgt ctg agg tgg cga aga cca gtc ccg cgc cca ccg gca gcc gga tca
cys ala ala thr arg leu arg trp arg arg pro val pro arg pro pro ala ala gly ser
481/161                                    511/171
ggt agg gca ggc gcg agt ctt cag cgg ggt tgg cgg cga cga gca gct cca cag agt gtg
gly arg ala gly ala ser leu gln arg gly trp arg arg arg ala ala pro gln ser val
541/181                                    571/191
agg gta cgg gcg gcg tac ggc aac ggt gaa gca ggc act ccg acg aac cca tcg tca cgt
arg val arg ala ala tyr gly asn gly glu ala gly thr pro thr asn pro ser ser arg
601/201
cga agg ggc agg tga
arg arg gly arg) OPA
```

SEQ ID NOS:333-334

FIG. 15D

R:Rv2530c predicted according to Cole et al. (Nature 393:537-544) and which may be in phase with SEQ15A 1/1 SEQ ID NO: 335                           31/11
gtg acg gca ctg ctc gat gtc aat gtg ctg atc gcg ctg ggc tgg ccg aat cac gtt cac
(val thr ala leu leu asp val asn val leu ile ala leu gly trp pro asn his val his
61/21 SEQ ID NO: 336                          91/31
cat gcg gcc gcg cag cga tgg ttc acg cag ttc tcc tcg aat ggg tgg gcc acc acg ccg
his ala ala ala gln arg trp phe thr gln phe ser ser asn gly trp ala thr thr pro
121/41                                        151/51
atc acc gag gca ggg tat gtc cga att tca agc aat cgc agt gtg atg cag gtg tcg acc
ile thr glu ala gly tyr val arg ile ser ser asn arg ser val met gln val ser thr
181/61                                        211/71
acg ccg gct atc gcg atc gct cag ttg gcg gcg atg act tct ctt gcc ggg cac acg ttt
thr pro ala ile ala ile ala gln leu ala ala met thr ser leu ala gly his thr phe
241/81                                        271/91
tgg cct gac gat gtg cca ctg atc gtt ggg agc gcc ggc gat cgc gat gcg gtg tcc aac
trp pro asp asp val pro leu ile val gly ser ala gly asp arg asp ala val ser asn
301/101                                       331/111
cac cgt cgg gtc acc gac tgc cat ctc atc gcc ttg gcc gcg cgc tac ggg ggc cgg ttg
his arg arg val thr asp cys his leu ile ala leu ala ala arg tyr gly gly arg leu
361/121                                       391/131
gtc aca ttc gat gcc gca ctg gcc gat tca gca tcc gca ggc ctc gtc gag gtg ttg tag
val thr phe asp ala ala leu ala asp ser ala ser ala gly leu val glu val leu)AMB

SEQ ID NOS:335-336

FIG. 15E

Seq15P: ORF according to Cole et al. (Nature 393:537-544) containing Rv2530c
1/1 SEQ ID NO: 337                            31/11
tga tgt tcc gcc gga tgc gcc gac ggt gac ttc cga gga tgt cgt ccg cgc gct cga gga
OPA(cys ser ala gly cys ala asp gly asp phe arg gly cys arg pro arg ala arg gly
61/21 SEQ ID NO: 338                          91/31
cga cgt gtg acg gca ctg ctc gat gtc aat gtg ctg atc gcg ctg ggc tgg ccg aat cac
arg arg val thr ala leu leu asp val asn val leu ile ala leu gly trp pro asn his
121/41                                        151/51
gtt cac cat gcg gcc gcg cag cga tgg ttc acg cag ttc tcc tcg aat ggg tgg gcc acc
val his his ala ala ala gln arg trp phe thr gln phe ser ser asn gly trp ala thr
181/61                                        211/71
acg ccg atc acc gag gca ggg tat gtc cga att tca agc aat cgc agt gtg atg cag gtg
thr pro ile thr glu ala gly tyr val arg ile ser ser asn arg ser val met gln val
241/81                                        271/91
tcg acc acg ccg gct atc gcg atc gct cag ttg gcg gcg atg act tct ctt gcc ggg cac
ser thr thr pro ala ile ala ile ala gln leu ala ala met thr ser leu ala gly his
301/101                                       331/111
acg ttt tgg cct gac gat gtg cca ctg atc gtt ggg agc gcc ggc gat cgc gat gcg gtg
thr phe trp pro asp asp val pro leu ile val gly ser ala gly asp arg asp ala val
361/121                                       391/131
tcc aac cac cgt cgg gtc acc gac tgc cat ctc atc gcc ttg gcc gcg cgc tac ggg ggc
ser asn his arg arg val thr asp cys his leu ile ala leu ala ala arg tyr gly gly
421/141                                       451/151
cgg ttg gtc aca ttc gat gcc gca ctg gcc gat tca gca tcc gca ggc ctc gtc gag gtg
arg leu val thr phe asp ala ala leu ala asp ser ala ser ala gly leu val glu val
481/161
ttg tag
leu)AMB

SEQ ID NOS:337-338

FIG. 15F

SEQ ID NO: 339: first frame nucleic acid
SEQ ID NO: 346: second frame nucleic acid
SEQ ID NO: 347: third frame nucleic acid
Fragment containing Seq15P' and Seq 15F'
1/1  SEQ ID NO: 339,346,347                 31/11
tga tgt tcc gcc gga tgc gcc gac ggt gac ttc cga gga tgt cgt ccg cgc gct cga gga
OPA(cys ser ala gly cys ala asp gly asp phe arg gly cys arg pro arg ala arg gly
  asp val pro pro asp ala pro thr val thr ser glu asp val val arg ala leu glu asp
   Met phe arg arg met arg arg arg)OPA(leu pro arg met ser ser ala arg ser arg thr
61/21   SEQ ID NO: 340    SEQ ID NO:348   91/31   SEQ ID NO: 349
cga cgt gtg acg gca ctg ctc gat gtc aat gtg ctg atc gcg ctg ggc tgg ccg aat cac
arg arg val thr ala leu leu asp val asn val leu ile ala leu gly trp pro asn his
 asp val OPA arg his cys ser met ser met cys OPA ser arg trp ala gly arg ile thr
  thr cys asp gly thr ala arg cys gln cys ala asp ar

```
661/221              SEQ ID NO: 342       691/231
ggt gag ggc ggc ggc tag ata gcg gta ggt gta ttc ctg ggc gag ctt gcg ggt ttg gca
gly glu gly gly gly)AMB(ile ala val gly val phe leu gly glu leu ala gly leu ala
 val arg ala ala ala arg AMB arg AMB val tyr ser trp ala ser leu arg val trp gln
  OPA(gly arg arg leu asp ser gly arg cys ile pro gly arg ala cys gly phe gly arg
721/241  SEQ ID NO: 351                   751/251
gaa cac gat cgg cac gtt ggg aaa gcc gat ctg caa ttc ggc cag ccc atc ggc gat cgc
glu his asp arg his val gly lys ala asp leu gln phe gly gln pro ile gly asp arg
 asn thr ile gly thr leu gly lys pro ile cys asn ser ala ser pro ser ala ile ala
  thr arg ser ala arg trp glu ser arg ser ala ile arg pro ala his arg arg ser pro
781/261                                   811/271
cgt cgg gcg ggc gaa gga gtg cgc gaa gat ctc cga gta gcg gtc ctc gac cac cac ggc
arg arg ala gly glu gly val arg glu asp leu arg val ala val leu asp his his gly
 val gly arg ala lys glu cys ala lys ile ser glu AMB arg ser ser thr thr thr ala
  ser gly gly arg arg ser ala arg arg ser pro ser ser gly pro arg pro pro arg arg
841/281                                   871/291
ggc ccg tgg cag cgc ggc cag ttc ggt cag ttg gta ttt cag gtt gcc gtt cag cac gcc
gly pro trp gln arg gly gln phe gly gln leu val phe gln val ala val gln his ala
 ala arg gly ser ala ala ser ser val ser trp tyr phe arg leu pro phe ser thr pro
  pro val ala ala arg pro val arg ser val gly ile ser gly cys arg ser ala arg gln
901/301                                   931/311
aga agt aag gtc cgc caa cgc ttt acg ctc gac ggc cgc cac gag ttg gcc ggc cac ttt
arg ser lys val arg gln arg phe thr leu asp gly arg his glu leu ala gly his phe
 glu val arg ser ala asn ala leu arg ser thr ala ala thr ser trp pro ala thr phe
  lys)OCH(gly pro pro thr leu tyr ala arg arg pro pro arg val gly arg pro leu ser
961/321   SEQ ID NO. 352                  991/331
cag gcc gta gtc gcc gca ggg cag ggc ttc ccg cgt cgt ctt cgc ggg ttt gtc ggc aaa
gln ala val val ala ala gly gln gly phe pro arg arg leu arg gly phe val gly lys
 arg pro AMB ser pro gln gly arg ala ser arg val val phe ala gly leu ser ala lys
  gly arg ser arg arg arg ala gly leu pro ala ser ser ser arg val cys arg gln arg
1021/341                                  1051/351
ggt gta ggg gta gcg ttc gtg ggc gtc gac gac gat gtg cag ctc ggg gat gcc ggc ggc
gly val gly val ala phe val gly val asp asp asp val gln leu gly asp ala gly gly
 val AMB gly AMB arg ser trp ala ser thr thr met cys ser ser gly met pro ala ala
  cys arg gly ser val arg gly arg arg arg arg cys ala ala arg gly cys arg arg arg
1081/361                                  1111/371
gcg ggc ggt ggg ggt gcg cac gcc cgg ccg cga ctg ttt gcg cgt ttt ggg gct ctg cca
ala gly gly gly gly ala his ala arg pro arg leu phe ala arg phe gly ala leu pro
 arg ala val gly val arg thr pro gly arg asp cys leu arg val leu gly leu cys gln
  gly arg trp gly cys ala arg pro ala ala thr val cys ala phe trp gly ser ala arg
1141/381                                  1171/391
gaa cac cac ctg gcg gcc gcg cgc cat ggt gtg cac cag ttg cga tcg gtt ctc ccg cgc
glu his his leu ala ala ala arg his gly val his gln leu arg ser val leu pro arg
 asn thr thr trp arg pro arg ala met val cys thr ser cys asp arg phe ser arg ala
  thr pro pro gly gly arg ala pro trp cys ala pro val ala ile gly ser pro ala arg
1201/401                                  1231/411      SEQ ID NO: 343
gcg ggc ggc gac gac gtc gat ggc cgc gcc ccg gcg gct gca gct gcg tag ctc gac ccg
ala gly gly asp asp val asp gly arg ala pro ala ala ala ala ala)AMB(leu asp pro
 arg ala ala thr thr ser met ala ala pro arg arg leu gln leu arg ser ser thr arg
  gly arg arg arg arg arg trp pro arg pro gly gly cys ser cys val ala arg pro gly
1261/421                                  1291/431
gtc gac gac gac ggg gtc ggc ggg cca gtc ggc gat gtc gag gcg atg gca ata cag cgc
val asp asp asp gly val gly gly pro val gly asp val glu ala met ala ile gln arg
 ser thr thr thr gly ser ala gly gln ser ala met ser arg arg trp gln tyr ser ala
  arg arg arg arg gly arg arg ala ser arg arg cys arg gly asp gly asn thr ala pro
```

SEQ ID NOS:339-352

FIG. 15G (continued 1)

1321/441     SEQ ID NO: 344              1351/451
ctt ggt gcg cgg cca cac gtc tga ggt ggc gaa gac cag tcc cgc gcc cac cgg cag ccg
leu gly ala arg pro his val)OPA(gly gly glu asp gln ser arg ala his arg gln pro
 leu val arg gly his thr ser glu val ala lys thr ser pro ala pro thr gly ser arg
  trp cys ala ala thr arg leu arg trp arg arg pro val pro arg pro pro ala ala gly
1381/461                                 1411/471
gat cag gta ggg cag gcg cga gtc ttc agc ggt ggc ggc gac gag cag ctc cac aga
asp gln val gly gln ala arg val phe ser gly val gly gly asp glu gln leu his arg
 ile arg AMB gly arg arg glu ser ser ala gly leu ala ala thr ser ser ser thr glu
  ser gly arg ala gly ala ser leu gln arg gly trp arg arg arg ala ala pro gln ser
1441/481      SEQ ID NO: 345             1471/491
gtg tga ggg tac ggg cgg cgt acg gca acg gtg aag cag gca ctc cga cga acc cat cgt
val)OPA(gly tyr gly arg arg thr ala thr val lys gln ala leu arg arg thr his arg
 cys glu gly thr gly gly val arg gln arg OPA ser arg his ser asp glu pro ile val
  val arg val arg ala ala tyr gly asn gly glu ala gly thr pro thr asn pro ser ser
1501/501
cac gtc gaa ggg gca ggt ga)
his val glu gly ala gly)
 thr ser lys gly gln val
  arg arg arg gly arg)OPA SEQ ID NOS:339-352 (continued 2)

FIG. 15G (continued (2)

SEQ ID NO: 353                              31/11
TGC GCA TGC CGA CCA GTG TGG TTG GCC GGA GTT CGT TTG TTC GCG ATT GCC TCA ACG ATT
(cys ala cys arg pro val trp leu ala gly val arg leu phe ala ile ala ser thr ile
61/21      SEQ ID NO: 354                   91/31
CGA TAT AAC CAC TCT AGT CAC ATC AAC CAC ACT CGT ACC ATC GAG CGT GTG GGT TCA TGC
arg tyr asn his ser ser his ile asn his thr arg thr ile glu arg val gly ser cys
121/41                                      151/51
CAT GCA TTC GCG ACC GCG GGA GCC GGC GAA CCC GGC GCC ACA CAT AAT CCA GAT TGA GGA
his ala phe ala thr ala gly ala gly glu pro gly ala thr his asn pro asp)OPA(gly
181/61                                      211/71     SEQ ID NO: 355
GAC TTC CGT GCC GAA CCG ACG CCG ACG CAA GCT TTC GAC AGC CAT GAG CGC GGT CGC CGC
asp phe arg ala glu pro thr pro thr gln ala phe asp ser his glu arg gly arg arg
241/81                                      271/91
CCT GGC AGT TGC AAG TCC TTG TGC ATA TTT TCT TGT CTA CGA ATC AAC CGA AAC GAC CGA
pro gly ser cys lys ser leu cys ile phe ser cys leu arg ile asn arg asn asp arg
301/101                                     331/111
GCG GCC CGA GCA CCA TGA ATT CAA GCA GGC GGT GTT GAC CGA CCT GCC CGG CGA GCT
ala ala arg ala pro)OPA(ile gln ala gly gly gly val asp arg pro ala arg arg ala
361/12    SEQ ID NO: 356                    391/131
GAT GTC CGC GCT ATC GCA GGG GTT GTC CCA GTT CGG GAT C
asp val arg ala ile ala gly val val pro val arg asp)

SEQ ID NOS:353-356

FIG. 16A

```
    SEQ ID NO: 357                          32/11
GCG CAT GCC GAC CAG TGT GGT TGG CCG GAG TTC GTT TGT TCG CGA TTG CCT CAA CGA TTC
(ala his ala asp gln cys gly trp pro glu phe val cys ser arg leu pro gln arg phe
 62/21    SEQ ID NO: 358                   92/31
GAT ATA ACC ACT CTA GTC ACA TCA ACC ACA CTC GTA CCA TCG AGC GTG TGG GTT CAT GCC
asp ile thr thr leu val thr ser thr thr leu val pro ser ser val trp val his ala
122/41                                    152/51
ATG CAT TCG CGA CCG GGG GAG CCG GCG AAC CCG GCG CCA CAC ATA ATC CAG ATT GAG GAG
met his ser arg pro arg glu pro ala asn pro ala pro his ile ile gln ile glu glu
182/61                                    212/71
ACT TCC GTG CCG AAC CGA CGC CGA CGC AAG CTT TCG ACA GCC ATG AGC GCG GTC GCC GCC
thr ser val pro asn arg arg arg arg lys leu ser thr ala met ser ala val ala ala
242/81                                    272/91
CTG GCA GTT GGA AGT CCT TGT GCA TAT TTT CTT GTC TAC GAA TCA ACC GAA ACG ACC GAG
leu ala val gly ser pro cys ala tyr phe leu val tyr glu ser thr glu thr thr glu
302/101                                   332/111
CGG CCC GAG CAC CAT GAA TTC AAG CAG GCG GCG GTG TTG ACC GAC CTG CCC GGC GAG CTG
arg pro glu his his glu phe lys gln ala ala val leu thr asp leu pro gly glu leu
362/121                                   392/131
ATG TCC GCG CTA TCG CAG GGG TTG TCC CAG TTC GGG ATC
met ser ala leu ser gln gly leu ser gln phe gly ile)

SEQ ID NOS:357-358

FIG. 16B

SEQ ID NO: 359                         33/11
CGC ATG CCG ACC AGT GTG GTT GGC CGG AGT TCG TTT GTT CGC GAT TGC CTC AAC GAT TCG
(arg met pro thr ser val val gly arg ser ser phe val arg asp cys leu asn asp ser
 63/21    SEQ ID NO: 360                   93/31
ATA TAA CCA CTC TAG TCA CAT CAA CCA CAC TCG TAC CAT CGA GCG TGT GGG TTC ATG CCA
ile)OCH pro leu AMB(ser his gln pro his ser tyr his arg ala cys gly phe met pro
123/41              SEQ ID NO: 926        153/51
TGC ATT CGC GAC CGC GGG AGC CGG CGA ACC CGG CGC CAC ACA TAA TCC AGA TTG AGG AGA
cys ile arg asp arg gly ser arg arg thr arg arg his thr)OCH(ser arg leu arg arg
183/61                                    213/71            SEQ ID NO: 927
CTT CCG TGC CGA ACC GAC GCC GAC GCA AGC TTT CGA CAG CCA TGA GCG CGG TCG CCG CCC
leu pro cys arg thr asp ala asp ala ser phe arg gln pro)OPA(ala arg ser pro pro
243/81                                    273/91            SEQ ID NO: 928
TGG CAG TTG CAA GTC CTT GTG CAT ATT TTC TTG TCT ACG AAT CAA CCG AAA CGA CCG AGC
trp gln leu gln val leu val his ile phe leu ser thr asn gln pro lys arg pro ser
303/101                                   333/111
GGC CCG AGC ACC ATG AAT TCA AGC AGG CGG CGG TGT TGA CCG ACC TGC CCG GCG AGC TGA
gly pro ser thr met asn ser ser arg arg arg cys)OPA(pro thr cys pro ala ser)OPA
363/121                                   393/131      SEQ ID NO: 929
TGT CCG CGC TAT CGC AGG GGT TGT CCC AGT TCG GGA TC
(cys pro arg tyr arg arg gly cys pro ser ser gly)
 SEQ ID NO: 930

SEQ ID NOS:359-360,926-930

FIG. 16C
```

SEQ ID NO: 361                         31/11
GCG GGC CAC CGA TCA GTC GAT CGG GTG GTT TCC GCT CCA TCA GCC CGG AAT TGA GGT GCC
(ala gly his arg ser val asp arg val val ser ala pro ser ala arg asn)OPA(gly ala
61/21      SEQ ID NO: 362                         91/31    SEQ ID NO: 363
GCA GTG ACG ACA CCA GCG CAG GAC GCG CCG TTG GTG TTT CCC TCT GTT GCT TTC CCG TCC
ala val thr thr pro ala gln asp ala pro leu val phe pro ser val ala phe pro ser
121/41                                 151/51
GGC TCG CCT TTT TTT CAT CAA CGT TGG ACT GCC GCA GTG GCG ATG TTG GTC GCC GGC GTG
gly ser pro phe phe his gln arg trp thr ala ala val ala met leu val ala gly val
181/61                                 211/71
TTC GGT CAC CTG ACG GTC GGG ATG TTC CTT GGG TCT CGG GTT GCT GCT GGG TTT GCT CAA
phe gly his leu thr val gly met phe leu gly ser arg val ala ala gly phe ala gln
241/81                                 271/91
TGC CCT GCT GGT GCG GCG TTC GGC CGA GTC GAT CAC CGC CAA AGA GCA CCC GTT AAA ACG
cys pro ala gly ala ala phe gly arg val asp his arg gln arg ala pro val lys thr
301/101                                331/111
GTC GAT GGC CCT CAA CTC GGC ATC GCG ACT GGC GAT TAT CAC CAT GCC TCG GGC TGA TC
val asp gly pro gln leu gly ile ala thr gly asp tyr his his ala ser gly)OPA

SEQ ID NOS:361-363

FIG. 17A

SEQ ID NO: 364                         32/11
CGG GCC ACC GAT CAG TCG ATC GGG TGG TTT CCG CTC CAT CAG CCC GGA ATT GAG GTG CCG
(arg ala thr asp gln ser ile gly trp phe pro leu his gln pro gly ile glu val pro
62/21    SEQ ID NO: 365                        92/31
CAG TGA CGA CAC CAG CGC AGG ACG CGC CGT TGG TGT TTC CCT CTG TTG CTT TCC GTC CG
gln)OPA(arg his gln arg arg thr arg arg trp cys phe pro leu leu leu ser arg pro
122/41       SEQ ID NO: 366             152/51
GCT CGC CTT TTT TCA TCA ACG TTG GAC TGC CGC AGT GGC GAT GTT GGT CGC CCG CGT GT
ala arg leu phe phe ile asn val gly leu pro gln trp arg cys trp ser pro ala cys
182/61                                 212/71
TCG GTC ACC TGA CGG TCG GAT GTT CCT TGG GTC TCG GGT TGC TGC TGG TTT GCT CAA T
ser val thr)OPA(arg ser gly cys ser leu gly leu gly leu leu leu gly leu leu asn
242/81            SEQ ID NO: 367        272/91
GCC CTG CTG GTG CGG CGT TCG GCC GAG TCG ATC ACC GCC AAA GAG CAC CCG TTA AAC GG
ala leu leu val arg arg ser ala glu ser ile thr ala lys glu his pro leu lys arg
302/101                                332/111
TCG ATG GCC CTC AAC TCG GCA TCG CGA CTG GCG ATT ATC ACC ATG CCT CGG GCT GAT C
ser met ala leu asn ser ala ser arg leu ala ile ile thr met pro arg ala asp)

SEQ ID NOS:364-367

FIG. 17B

SEQ ID NO: 368                                   33/11
GGG CCA CCG ATC AGT CGA TCG GGT GGT TTC CGC TCC ATC AGC CCG GAA TTG AGG TGC CGC
(gly pro pro ile ser arg ser gly gly phe arg ser ile ser pro glu leu arg cys arg
63/21    SEQ ID NO: 369                         93/31
AGT GAC GAC ACC AGC GCA GGA CGC GCC GTT GGT GTT TCC CTC TGT TGC TTT CCC GTC CGG
ser asp asp thr ser ala gly arg ala val gly val ser leu cys cys phe pro val arg
123/41                                           153/51
CTC GCC TTT TTT TCA TCA ACG TTG GAC TGC CGC AGT GGC GAT GTT GGT CGC GGT CGT GTT
leu ala phe phe ser ser thr leu asp cys arg ser gly asp val gly arg arg arg val
183/61                                           213/71
CGG TCA CCT GAC GGT CGG GAT GTT CCT TGG GTC TCG GGT TGC TGC TGG GTT TGC TCA ATG
arg ser pro asp gly arg asp val pro trp val ser gly cys cys trp val cys ser met
243/81                                           273/91
CCC TGC TGG TGC GGC GTT CGG CCG AGT CGA TCA CCG CCA AAG AGC ACC CGT TAA AAC GGT
pro cys trp cys gly val arg pro ser arg ser pro pro lys ser thr arg)OCH(asn gly
303/101                                          333/111    SEQ ID NO: 370
CGA TGG CCC TCA ACT CGG CAT CGC GAC TGG CGA TTA TCA CCA TGC CTC GGG CTG ATC
arg trp pro ser thr arg his arg asp trp arg leu ser pro cys leu gly leu ile)

SEQ ID NOS:368-370

FIG. 17C part of the nucleotide sequence of seq17A

1/1    SEQ ID NO: 371                           31/11
(ggc tag aac ccc gaa gga gac ctc gcg ggt tgc cgg ccc ccg gcc cat cgg atg cgt atc
gly AMB(asn pro glu gly asp leu ala gly cys arg pro pro ala his arg met arg ile
61/21    SEQ ID NO: 372                         91/31
cgg tcg cgc cga ttc acg acc gac ata ggg agc tac ccc ttg ggt gat tcc ggt gcg acg
arg ser arg arg phe thr thr asp ile gly ser tyr pro leu gly asp ser gly ala thr
121/41                                           151/51
act gcg ata cgc tcg gcg ggc cac cga tca gtc gat cgg gtg gtt tcc gct cca tca gcc
thr ala ile arg ser ala gly his arg ser val asp arg val val ser ala pro ser ala
181/61                                           211/71
cgg aat tga ggt gcc gca gtg acg aca cca gcg cag gac gcg ccg ttg gtg ttt ccc tct
arg asn)OPA(gly ala ala val thr thr pro ala gln asp ala pro leu val phe pro ser
241/81       SEQ ID NO: 373                      271/91
gtt gct ttc cgt ccg gtt cgc ctt ttt ttc atc aac gtt gga ctg gcc gca gtg gcg atg
val ala phe arg pro val arg leu phe phe ile asn val gly leu ala ala val ala met
301/101                                          331/111
ttg gtc gcc ggc gtg ttc ggt cac ctg acg gtc ggg atg ttc ttg ggt ctc ggg ttg ctg
leu val ala gly val phe gly his leu thr val gly met phe leu gly leu gly leu leu
361/121                                          391/131
ctg ggt ttg ctc aat gcc ctg ctg gtg cgg cgt tcg gcc gag tcg atc acc gcc aaa gag
leu gly leu leu asn ala leu leu val arg arg ser ala glu ser ile thr ala lys glu
421/141                                          451/151
cac ccg tta aaa cgg tcg atg gcc ctc aac tcg gca tcg cga ctg gcg att atc acc atc
his pro leu lys arg ser met ala leu asn ser ala ser arg leu ala ile ile thr ile
481/161
ctc ggg ctg atc
leu gly leu ile)

SEQ ID NOS:371-373

FIG. 17A'

1/1 SEQ ID NO: 374                          31/11
gct aga acc ccg aag gag acc tcg cgg gtt gcc ggc ccc cgg ccc atc gga tgc gta tcc
(ala arg thr pro lys glu thr ser arg val ala gly pro arg pro ile gly cys val ser
61/21  SEQ ID NO: 375                       91/31
ggt cgc gcc gat tca cga ccg aca tag gga gct acc cct tgg gtg att ccg gtg cga cga
gly arg ala asp ser arg pro thr)AMB(gly ala thr pro trp val ile pro val arg arg
121/41         SEQ ID NO: 376               151/51
ctg cga tac gct cgg cgg gcc acc gat cag tcg atc ggg tgg ttt ccg ctc cat cag ccc
leu arg tyr ala arg arg ala thr asp gln ser ile gly trp phe pro leu his gln pro
181/61                                      211/71
gga att gag gtg ccg cag tga cga cac cag cgc agg acg cgc cgt tgg tgt ttc cct ctg
gly ile glu val pro gln)OPA(arg his gln arg arg thr arg arg trp cys phe pro leu
241/81    SEQ ID NO: 377                    271/91
ttg ctt tcc gtc cgg ttc gcc ttt ttt tca tca acg ttg gac tgg ccg cag tgg cga tgt
leu leu ser val arg phe ala phe phe ser ser thr leu asp trp pro gln trp arg cys
301/101                                     331/111
tgg tcg ccg gcg tgt tcg gtc acc tga cgg tcg gga tgt tct tgg gtc tcg ggt tgc tgc
trp ser pro ala cys ser val thr)OPA(arg ser gly cys ser trp val ser gly cys cys
361/121           SEQ ID NO: 378            391/131
tgg gtt tgc tca atg ccc tgc tgg tgc ggc gtt cgg ccg agt cga tca ccg cca aag agc
trp val cys ser met pro cys trp cys gly val arg pro ser arg ser pro pro lys ser
421/141                                     451/151
acc cgt taa aac ggt cga tgg ccc tca act cgg cat cgc gac tgg cga tta tca cca tcc
thr arg)OCH(asn gly arg trp pro ser thr arg his arg asp trp arg leu ser pro ser
481/161        SEQ ID NO: 379
tcg ggc tga tc
ser gly)OPA

SEQ ID NOS:374-379

FIG. 17B'

1/1 SEQ ID NO: 380                          31/11
cta gaa ccc cga agg aga cct cgc ggg ttg ccg gcc ccc ggc cca tcg gat gcg tat ccg
(leu glu pro arg arg arg pro arg gly leu pro ala pro gly pro ser asp ala tyr pro
61/21  SEQ ID NO: 381                       91/31
gtc gcg ccg att cac gac cga cat agg gag cta ccc ctt ggg tga ttc cgg tgc gac gac
val ala pro ile his asp arg his arg glu leu pro leu gly)OPA(phe arg cys asp asp
121/41                                      151/51          SEQ ID NO: 382
tgc gat acg ctc ggc ggg cca ccg atc agt cga tcg ggt ggt ttc cgc tcc atc agc cg
cys asp thr leu gly gly pro pro ile ser arg ser gly gly phe arg ser ile ser pro
181/61                                      211/71
gaa ttg agg tgc cgc agt gac gac acc agc gca gga cgc gcc gtt ggt gtt tcc ctc tgt
glu leu arg cys arg ser asp asp thr ser ala gly arg ala val gly val ser leu cys
241/81                                      271/91
tgc ttt ccg tcc ggt tcg cct ttt ttc atc aac gtt gga cgc agt ggc gat gtt
cys phe pro ser gly ser pro phe phe his gln arg trp thr gly arg ser gly asp val
301/101                                     331/111
ggt cgc cgg cgt gtt cgg tca cct gac ggt cgg gat gtt ctt ggg tct cgg gtt gct gct
gly arg arg arg val arg ser pro asp gly arg asp val leu gly ser arg val ala ala
361/121                                     391/131
ggg ttt gct caa tgc cct gct ggt gcg gcg ttc ggc cga gtc gat cac cgc aaa gag ca
gly phe ala gln cys pro ala gly ala ala phe gly arg val asp his arg gln arg ala
421/141                                     451/151
ccc gtt aaa acg gtc gat ggc cct caa ctc ggc atc gcg act ggc gat tat cac cat cct
pro val lys thr val asp gly pro gln leu gly ile ala thr gly asp tyr his his pro
481/161
cgg gct gat c
arg ala asp)

SEQ ID NOS:380-382

FIG. 17C' sequence Rv1303 predicted by Cole et al. (Nature 393:537-544) and partially
containing Seq17A'

1/1 — SEQ ID NO: 383                          31/11
atg acg aca cca gcg cag gac gcg ccg ttg gtg ttt ccc tct gtt gct ttc cgt ccg gtt
(met thr thr pro ala gln asp ala pro leu val phe pro ser val ala phe arg pro val
61/21 — SEQ ID NO: 384                         91/31
cgc ctt ttt ttc atc aac gtt gga ctg gcc gca gtg gcg atg ttg gtc gcc ggc gtg ttc
arg leu phe phe ile asn val gly leu ala ala val ala met leu val ala gly val phe
121/41                                         151/51
ggt cac ctg acg gtc ggg atg ttc ttg ggt ctc ggg ttg ctg ctg ggt ttg ctc aat gcc
gly his leu thr val gly met phe leu gly leu gly leu leu leu gly leu leu asn ala
181/61                                         211/71
ctg ctg gtg cgg cgt tcg gcc gag tcg atc acc gcc aaa gag cac ccg tta aaa cgg tcg
leu leu val arg arg ser ala glu ser ile thr ala lys glu his pro leu lys arg ser
241/81                                         271/91
atg gcc ctc aac tcg gca tcg cga ctg gcg att atc acc atc ctc ggg ctg atc atc gcc
met ala leu asn ser ala ser arg leu ala ile ile thr ile leu gly leu ile ile ala
301/101                                        331/111
tac att ttc cgg ccc gct gga ttg ggc gtc gtg ttc ggg ctg gca ttc ttc cag gtg ctg
tyr ile phe arg pro ala gly leu gly val val phe gly leu ala phe phe gln val leu
361/121                                        391/131
ctg gtg gca acg acg gcc ctg ccg gtc ctg aag aag ctg cgc act gcg acc gag gaa ccg
leu val ala thr thr ala leu pro val leu lys lys leu arg thr ala thr glu glu pro
421/141                                        451/151
gtc gca act tat tct tcc aat ggc cag acc ggg gga tcg gaa gga agg agc gcc agc gat
val ala thr tyr ser ser asn gly gln thr gly gly ser glu gly arg ser ala ser asp
481/161
gac tga
asp)OPA

SEQ ID NOS:383-384

FIG. 17D

Orf according to Cole et al. (Nature 393:537-544) and containing Rv1303
1/1 — SEQ ID NO: 385                           31/11
tga ggt gcc gca gtg acg aca cca gcg cag gac gcg ccg ttg gtg ttt ccc tct gtt gct
OPA(gly ala ala val thr thr pro ala gln asp ala pro leu val phe pro ser val ala
61/21 — SEQ ID NO: 386                         91/31
ttc cgt ccg gtt cgc ctt ttt ttc atc aac gtt gga ctg gcc gca gtg gcg atg ttg gtc
phe arg pro val arg leu phe phe ile asn val gly leu ala ala val ala met leu val
121/41                                         151/51
gcc ggc gtg ttc ggt cac ctg acg gtc ggg atg ttc ttg ggt ctc ggg ttg ctg ctg ggt
ala gly val phe gly his leu thr val gly met phe leu gly leu gly leu leu leu gly
181/61                                         211/71
ttg ctc aat gcc ctg ctg gtg cgg cgt tcg gcc gag tcg atc acc gcc aaa gag cac ccg
leu leu asn ala leu leu val arg arg ser ala glu ser ile thr ala lys glu his pro
241/81                                         271/91
tta aaa cgg tcg atg gcc ctc aac tcg gca tcg cga ctg gcg att atc acc atc ctc ggg
leu lys arg ser met ala leu asn ser ala ser arg leu ala ile ile thr ile leu gly
301/101                                        331/111
ctg atc atc gcc tac att ttc cgg ccc gct gga ttg ggc gtc gtg ttc ggg ctg gca ttc
leu ile ile ala tyr ile phe arg pro ala gly leu gly val val phe gly leu ala phe
361/121                                        391/131
ttc cag gtg ctg ctg gtg gca acg acg gcc ctg ccg gtc ctg aag aag ctg cgc act gcg
phe gln val leu leu val ala thr thr ala leu pro val leu lys lys leu arg thr ala
421/141                                        451/151
acc gag gaa ccg gtc gca act tat tct tcc aat ggc cag acc ggg gga tcg gaa gga agg
thr glu glu pro val ala thr tyr ser ser asn gly gln thr gly gly ser glu gly arg
481/161
agc gcc agc gat gac tga
ser ala ser asp asp)OPA

SEQ ID NOS:385-386

FIG. 17E

SEQ ID NO: 387                                                31/11
GTC GAA CAG GTA CGG AAG GCG CCG TCG GTC GCT CGG TCC GCT GGT ATC TCG TGT TCA GCC
(val glu gln val arg lys ala pro ser val ala arg ser ala gly ile ser cys ser ala
61/21    SEQ ID NO: 388                                      91/31
AGC CAG CGG CCG TTA ACG TGG CCG AAC AGG TCG TCT TGG GGT CGG GCA TCA GCG TCG ATG
ser gln arg pro leu thr trp pro asn arg ser ser trp gly arg ala ser ala ser met
121/41                                                       151/51
TGG CTC AGG TCG ATA CCC GAG GGG ATG GCA AGT GTC ACC CCG CCA TCC TTC CAC CTC TTT
trp leu arg ser ile pro glu gly met ala ser val thr pro pro ser phe his leu phe
181/61                                                       211/71
TCG GGT GCA ACG ATC GGG CCA TGC CTG ACG GGG AGC AGA GCC AGC CAC CGG CCC AAG AAG
ser gly ala thr ile gly pro cys leu thr gly ser arg ala ser his arg pro lys lys
241/81                                                       271/91
ATG CGG AAG ACG ACT CGC GGC CCG ACG CCG CGG AGG CCG CCG CGG CCG AAC CCA AAT CAT
met arg lys thr thr arg gly pro thr pro arg arg pro pro arg pro asn pro asn his
301/101                                                      331/111
CAG CCG GTC CCG ATG TTC TCG ACC TAC GGT ATC GCC TCG ACA CTA CTC GGC GTG CTA TCG
gln pro val pro met phe ser thr tyr gly ile ala ser thr leu leu gly val leu ser
361/121
GTC GCC GCG GTC GTG CTG GGT GCG ATG ATC
val ala ala val val leu gly ala met ile)

SEQ ID NOS:387-388

FIG. 18A

SEQ ID NO: 389                                                32/11
TCG AAC AGG TAC GGA AGG CGC CGT CGG TCG CTC GGT CCG CTG GTA TCT CGT GTT CAG CCA
(ser asn arg tyr gly arg arg arg arg ser leu gly pro leu val ser arg val gln pro
62/21     SEQ ID NO: 390                                     92/31
GCC AGC GGC CGT TAA CGT GGC CGA ACA GGT CGT CTT GGG GTC GGG CAT CAG CGT CGA TGT
ala ser gly arg)OCH(arg gly arg thr gly arg leu gly val gly his gln arg arg cys
122/41           SEQ ID NO: 391                              152/51
GGC TCA GGT CGA TAC CCG AGG GGA TGG CAA GTG TCA CCC GCC ATC CTT CCA CCT CTT TTC
gly ser gly arg tyr pro arg gly trp gln val ser pro arg his pro ser thr ser phe
182/61                                                       212/71
CGG GTG CAA CGA TCG GGC CAT GCC TGA CGG GGA GCA GAG CCA GCC ACC GGC CCA AGA AGA
arg val gln arg ser gly his ala)OPA(arg gly ala glu pro ala thr gly pro arg arg
242/81         SEQ ID NO: 392                                272/91
TGC GGA AGA CGA CTC GCG GCC CGA CGC CGC GGA GGC CGC CGC GGC CGA ACC CAA ATC ATC
cys gly arg arg leu ala ala arg arg gly gly arg arg gly arg thr gln ile ile
302/101                                                      332/111
AGC CGG TCC CGA TGT TCT CGA CCT ACG GTA TCG CCT CGA CAC TAC TCG GCG TGC TAT CGG
ser arg ser arg cys ser arg pro thr val ser pro arg his tyr ser ala cys tyr arg
362/121
TCG CCG CGG TCG TGC TGG GTG CGA TGA TC
ser pro arg ser cys trp val arg)OPA

SEQ ID NOS:389-392

FIG. 18B

```
3/1   SEQ ID NO: 393                          33/11
CGA ACA GGT ACG GAA GGC GCC GTC GGT CGC TCG GTC CGC TGG TAT CTC GTG TTC AGC CAG
(arg thr gly thr glu gly ala val gly arg ser val arg trp tyr leu val phe ser gln
63/21   SEQ ID NO: 394                        93/31
CCA GCG GCC GTT AAC GTG GCC GAA CAG GTC GTC TTG GGG TCG GGC ATC AGC GTC GAT GTG
pro ala ala val asn val ala glu gln val val leu gly ser gly ile ser val asp val
123/41                                        153/51
GCT CAG GTC GAT ACC CGA GGG GAT GGC AAG TGT CAC CCC GCC ATC CTT CCA CCT CTT TTC
ala gln val asp thr arg gly asp gly lys cys his pro ala ile leu pro pro leu phe
183/61                                        213/71
GGG TGC AAC GAT CGG GCC ATG CCT GAC GGG GAG CAG AGC CAG CCA CCG GCC CAA GAA GAT
gly cys asn asp arg ala met pro asp gly glu gln ser gln pro pro ala gln glu asp
243/81                                        273/91
GCG GAA GAC GAC TCG CGG CCC GAC GCC GCG GAG GCC GCC GCG GCC GAA CCC AAA TCA TCA
ala glu asp asp ser arg pro asp ala ala glu ala ala ala ala glu pro lys ser ser
303/101                                       333/111
GCC GGT CCC GAT GTT CTC GAC CTA CGG TAT CGC CTC GAC ACT ACT CGG CGT GCT ATC GGT
ala gly pro asp val leu asp leu arg tyr arg leu asp thr thr arg arg ala ile gly
363/121
CGC CGC GGT CGT GCT GGG TGC GAT GAT C
arg arg gly arg ala gly cys asp asp)
```

SEQ ID NOS:393-394

FIG. 18C

```
part of the nucleotide sequence of seq18A
1/1   SEQ ID NO: 395                          31/11
GAA GGC GCC GTC GGT CGC TCG GTC CGC TGG TAT CTC GTG TTC AGC CAG CCA GCG GCC GTT
(glu gly ala val gly arg ser val arg trp tyr leu val phe ser gln pro ala ala val
61/21   SEQ ID NO: 396                        91/31
AAC GTG GCC GAA CAG GTC GTC TTG GGG TCG GGC ATC AGC GTC GAT GTG GCT CAG GTC GAT
asn val ala glu gln val val leu gly ser gly ile ser val asp val ala gln val asp
121/41                                        151/51
ACC CGA GGG GAT GGC AAG TGT CAC CCC GCC ATC CTT CCA CCT CTT TTC GGG TGC AAC GAT
thr arg gly asp gly lys cys his pro ala ile leu pro pro leu phe gly cys asn asp
181/61                                        211/71
CGG GCC ATG CCT GAC GGG GAG CAG AGC CAG CCA CCG GCC CAA GAA GAT GCG GAA GAC GAC
arg ala met pro asp gly glu gln ser gln pro pro ala gln glu asp ala glu asp asp
241/81                                        271/91
TCG CGG CCC GAC GCC GCG GAG GCC GCC GCG GCC GAA CCC AAA TCA TCA GCC GGT CCG ATG
ser arg pro asp ala ala glu ala ala ala ala glu pro lys ser ser ala gly pro met
301/101                                       331/111
TTC TCG ACC TAC GGT ATC GCC TCG ACA CTA CTC GGC GTG CTA TCG GTC GCC GCG GTC GTG
phe ser thr tyr gly ile ala ser thr leu leu gly val leu ser val ala ala val val
361/121
CTG GGT GCG ATG ATC
leu gly ala met ile)
```

SEQ ID NOS:395-396

FIG. 18A'

```
1/1  ─SEQ ID NO: 397                    31/11
CGG AAG GCG CCG TCG GTC GCT CGG TCC GCT GGT ATC TCG TGT TCA GCC AGC CAG CGG CCG
(arg lys ala pro ser val ala arg ser ala gly ile ser cys ser ala ser gln arg pro
61/21 ─SEQ ID NO: 398                   91/31
TTA ACG TGG CCG AAC AGG TCG TCT TGG GGT CGG GCA TCA GCG TCG ATG TGG CTC AGG TCG
leu thr trp pro asn arg ser ser trp gly arg ala ser ala ser met trp leu arg ser
121/41                                  151/51
ATA CCC GAG GGG ATG GCA AGT GTC ACC CCG CCA TCC TTC CAC CTC TTT TCG GGT GCA ACG
ile pro glu gly met ala ser val thr pro pro ser phe his leu phe ser gly ala thr
181/61                                  211/71
ATC GGG CCA TGC CTG ACG GGG AGC AGA GCC AGC CAC CGG CCC AAG AAG ATG CGG AAG ACG
ile gly pro cys leu thr gly ser arg ala ser his arg pro lys lys met arg lys thr
241/81                                  271/91
ACT CGC GGC CCG ACG CCG CGG AGG CCG CCG CGG CCG AAC CCA AAT CAT CAG CCG GTC CGA
thr arg gly pro thr pro arg arg pro pro arg pro asn pro asn his gln pro val arg
301/101                                 331/111
TGT TCT CGA CCT ACG GTA TCG CCT CGA CAC TAC TCG GCG TGC TAT CGG TCG CCG CGG TCG
cys ser arg pro thr val ser pro arg his tyr ser ala cys tyr arg ser pro arg ser
361/121
TGC TGG GTG CGA TGA TC
cys trp val arg)OPA
```

SEQ ID NOS: 397-398

FIG. 18B'

```
1/1  ─SEQ ID NO: 399                    31/11
GGA AGG CGC CGT CGG TCG CTC GGT CCG CTG GTA TCT CGT GTT CAG CCA GCC AGC GGC CGT
(gly arg arg arg arg ser leu gly pro leu val ser arg val gln pro ala ser gly arg)
61/21 ─SEQ ID NO: 400                   91/31
TAA CGT GGC CGA ACA GGT CGT CTT GGG GTC GGG CAT CAG CGT CGA TGT GGC TCA GGT CGA
OCH(arg gly arg thr gly arg leu gly val gly his gln arg arg cys gly ser gly arg
121/41 ─SEQ ID NO: 401                  151/51
TAC CCG AGG GGA TGG CAA GTG TCA CCC GCC ATC CTT CCA CCT CTT TCG GTG CAA CGA
tyr pro arg gly trp gln val ser pro arg his pro ser thr ser phe arg val gln arg
181/61                                  211/71
TCG GGC CAT GCC TGA CGG GGA GCA GAG CCA GCC ACC GGC CCA AGA AGA TGC GGA AGA CGA
ser gly his ala)OPA(arg gly ala glu pro ala thr gly pro arg arg cys gly arg arg
241/81       ─SEQ ID NO: 402            271/91
CTC GCG GCC CGA CGC CGC GGA GGC CGC CGC GGC CGA ACC AAA TCA TCA GCC GGT CCG AT
leu ala ala arg arg arg gly gly arg arg gly arg thr gln ile ile ser arg ser asp
301/101                                 331/111
GTT CTC GAC CTA CGG TAT CGC CTC GAC ACT ACT CGG CGT GCT ATC GGT CGC CGC GGT CGT
val leu asp leu arg tyr arg leu asp thr thr arg arg ala ile gly arg arg gly arg
361/121
GCT GGG TGC GAT GAT C
ala gly cys asp asp)
```

SEQ ID NOS:399-402

FIG. 18C' sequence Rv0199 predicted by Cole et al. (Nature 393:537-544) and
containing seq18A'

```
1/1   SEQ ID NO: 403                        31/11
atg cct gac ggg gag cag agc cag cca ccg gcc caa gaa gat gcg gaa gac gac tcg cgg
(Met pro asp gly glu gln ser gln pro pro ala gln glu asp ala glu asp asp ser arg
61/21   SEQ ID NO: 404                      91/31
ccc gac gcc gcg gag gcc gcc gcg gcc gaa ccc aaa tca tca gcc ggt ccg atg ttc tcg
pro asp ala ala glu ala ala ala ala glu pro lys ser ser ala gly pro met phe ser
121/41                                      151/51
acc tac ggt atc gcc tcg aca cta ctc ggc gtg cta tcg gtc gcc gcg gtc gtg ctg ggt
thr tyr gly ile ala ser thr leu leu gly val leu ser val ala ala val val leu gly
181/61                                      211/71
gcg atg atc tgg tcc gca cac cgc gat gac tcc ggc gag cgt acc tac ctg acc cgg gtc
ala met ile trp ser ala his arg asp asp ser gly glu arg thr tyr leu thr arg val
241/81                                      271/91
atg ctg acc gcc gct gaa tgg acg gcc gtg ctg atc aac atg aac gcc gac aac atc gat
met leu thr ala ala glu trp thr ala val leu ile asn met asn ala asp asn ile asp
301/101                                     331/111
gcc agc ctg cag cga ctg cac gac gga acg gtc ggt caa ctc aac acc gac ttc gac gct
ala ser leu gln arg leu his asp gly thr val gly gln leu asn thr asp phe asp ala
361/121                                     391/131
gtc gtg cag ccc tac cgg cag gtg gtg gag aag ttg cgg acg cac agc agc ggc agg atc
val val gln pro tyr arg gln val val glu lys leu arg thr his ser ser gly arg ile
421/141                                     451/151
gag gcg gta gcg atc gat acg gtg cac cgc gag ctg gat acc cag tcc ggt gcc gcc cga
glu ala val ala ile asp thr val his arg glu leu asp thr gln ser gly ala ala arg
481/161                                     511/171
ccg gta gta acc acg aaa ttg cca ccg ttt gcc act cgc acc gac tcg gtg ctg ctg gtc
pro val val thr thr lys leu pro pro phe ala thr arg thr asp ser val leu leu val
541/181                                     571/191
gcg acg tcg gtc agt gag aac gcc ggc gcc aaa ccc cag acc gtg cac tgg aac ttg cgg
ala thr ser val ser glu asn ala gly ala lys pro gln thr val his trp asn leu arg
601/201                                     631/211
ctc gat gtc tcc gat gtg gac ggc aag ctg atg atc tcc cgg ttg gag tcg att cga tga
leu asp val ser asp val asp gly lys leu met ile ser arg leu glu ser ile arg)OPA
```

SEQ ID NOS:403-404

FIG. 18D

ORF according to Cole et al. (Nature 393:537-544) and containing Rv0199

```
1/1  SEQ ID NO: 405                    31/11
taa tcc gat gcc gga ttg ggt gaa atg cac caa gta acg ggt cga gtc ttt gga atc ggt
OCH(ser asp ala gly leu gly glu met his gln val thr gly arg val phe gly ile gly
61/21  SEQ ID NO: 406                  91/31
atc gac ata gac tcc gat gcc gcc gcc cac gcc ggc acg ttg cag agt gcc aag ggc ggc
ile asp ile asp ser asp ala ala ala his ala gly thr leu gln ser ala lys gly gly
121/41                                 151/51
ggc caa ttc ggt ggc gtc ggc cgc gct gtc aat cgt ggc caa ttc gtc gtg cag cgg ttg
gly gln phe gly gly val gly arg ala val asn arg gly gln phe val val gln arg leu
181/61                                 211/71
cac ccc tgc gcg ctc gac ggc ttc ctc gtc gag gaa gct ggc gta gag gtc gcc gat gcg
his pro cys ala leu asp gly phe leu val glu glu ala gly val glu val ala asp ala
241/81                                 271/91
ctg cgc atc ggt gcc tac cgc agc acc tgc ttg gct ggc ctg gat gat cag gtc tcg cac
leu arg ile gly ala tyr arg ser thr cys leu ala gly leu asp asp gln val ser his
301/101                                331/111
ttg tgt ctc ggc gcg gtc gaa cag gct acg gaa ggc gcc gtc ggt cgc tcg gtc cgc tgg
leu cys leu gly ala val glu gln ala thr glu gly ala val gly arg ser val arg trp
361/121                                391/131
tat ctc gtg ttc agc cag cca gcg gcc gtt aac gtg gcc gaa cag gtc gtc ttg ggg tcg
tyr leu val phe ser gln pro ala ala val asn val ala glu gln val val leu gly ser
421/141                                451/151
ggc atc agc gtc gat gtg gct cag gtc gat acc cga ggg gat ggc aag tgt cac ccc gcc
gly ile ser val asp val ala gln val asp thr arg gly asp gly lys cys his pro ala
481/161                                511/171
atc ctt cca cct ctt ttc ggg tgc aac gat cgg gcc atg cct gac ggg gag cag agc cag
ile leu pro pro leu phe gly cys asn asp arg ala met pro asp gly glu gln ser gln
541/181                                571/191
cca ccg gcc caa gaa gat gcg gaa gac gac tcg cgg ccc gac gcc gcg gag gcc gcc gcg
pro pro ala gln glu asp ala glu asp asp ser arg pro asp ala ala glu ala ala ala
601/201                                631/211
gcc gaa ccc aaa tca tca gcc ggt ccg atg ttc tcg acc tac ggt atc gcc tcg aca cta
ala glu pro lys ser ser ala gly pro met phe ser thr tyr gly ile ala ser thr leu
661/221                                691/231
ctc ggc gtg cta tcg gtc gcc gcg gtc gtg ctg ggt gcg atg atc tgg tcc gca cac cgc
leu gly val leu ser val ala ala val val leu gly ala met ile trp ser ala his arg
721/241                                751/251
gat gac tcc ggc gag cgt acc tac ctg acc cgg gtc atg ctg acc gcc gct gaa tgg acg
asp asp ser gly glu arg thr tyr leu thr arg val met leu thr ala ala glu trp thr
781/261                                811/271
gcc gtg ctg atc aac atg aac gcc gac aac atc gat gcc agc ctg cag cga ctg cac gac
ala val leu ile asn met asn ala asp asn ile asp ala ser leu gln arg leu his asp
841/281                                871/291
gga acg gtc ggt caa ctc aac acc gac ttc gac gct gtc gtg cag ccc tac cgg cag gtg
gly thr val gly gln leu asn thr asp phe asp ala val val gln pro tyr arg gln val
901/301                                931/311
gtg gag aag ttg cgg acg cac agc agc ggc agg atc gag gcg gta gcg atc gat acg gtg
val glu lys leu arg thr his ser ser gly arg ile glu ala val ala ile asp thr val
961/321                                991/331
cac cgc gag ctg gat acc cag tcc ggt gcc gcc cga ccg gta gta acc acg aaa ttg cca
his arg glu leu asp thr gln ser gly ala ala arg pro val val thr thr lys leu pro
1021/341                               1051/351
ccg ttt gcc act cgc acc gac tcg gtg ctg ctg gtc gcg acg tcg gtc agt gag aac gcc
pro phe ala thr arg thr asp ser val leu leu val ala thr ser val ser glu asn ala
1081/361                               1111/371
ggc gcc aaa ccc cag acc gtg cac tgg aac ttg cgg ctc gat gtc tcc gat gtg gac ggc
gly ala lys pro gln thr val his trp asn leu arg leu asp val ser asp val asp gly
1141/381                               1171/391
aag ctg atg atc tcc cgg ttg gag tcg att cga tga
lys leu met ile ser arg leu glu ser ile arg)OPA
```

SEQ ID NOS:405-406

FIG. 18E

```
          ┌─SEQ ID NO: 407                              31/11
GTT GCG CAA CGG GGT GAG CAC CGA CGC GAT GAT GGC GCA ACT ATC GAA ACT GCA GGA CAT
(val ala gln arg gly glu his arg arg asp asp gly ala thr ile glu thr ala gly his
61/21    ┌─SEQ ID NO: 408                              91/31
CGC CAA CGC CAA CGA CGG CAC TCG CGC GGT GGG CAC CCC TGG CTA TCA GGC CAG CGT CGA
arg gln arg gln arg arg his ser arg gly gly his pro trp leu ser gly gln arg arg
121/41                                                151/51
CTA TGT GGT AAA CAC ACT GCG CAA CAG CGG TTT TGA TGT GCA AAC CCC GGA GTT CTC CGC
leu cys gly lys his thr ala gln gln arg phe)OPA(cys ala asn pro gly val leu arg
181/61                                    211/71     └─SEQ ID NO: 409
TCG CGT GTT CAA GGC CGA AAA AGG GGT GGT GAC CCT CGG CGG CAA CAC CGT GGA GGC GAG
ser arg val gln gly arg lys arg gly gly asp pro arg arg gln his arg gly gly glu
241/81                                                271/91
GGC GCT CGA GTA CAG CCT CGG CAC ACC GCC GGA CGG GGT GAC GGG CCC GCT GGT GGC TGC
gly ala arg val gln pro arg his thr ala gly arg gly asp gly pro ala gly gly cys
301/101                                               331/111
CCC CGC CGA CGA CAG TCC GGG CTG CAG TCC GTC GGA CTA CGA CAG GCT GCC GGT GTC CGG
pro arg arg arg gln ser gly leu gln ser val gly leu arg gln ala ala gly val arg
361/121
TGC GGT GGT GCT GGT AGA TC
cys gly gly ala gly arg)
```

SEQ ID NOS: 407-409

FIG. 19A

```
          ┌─SEQ ID NO: 410                              32/11
TTG CGC AAC GGG GTG AGC ACC GAC GCG ATG ATG GCG CAA CTA TCG AAA CTG CAG GAC ATC
(leu arg asn gly val ser thr asp ala met met ala gln leu ser lys leu gln asp ile
62/21    ┌─SEQ ID NO: 411                              92/31
GCC AAC GCC AAC GAC GGC ACT CGC GCG GTG GGC ACC CCT GGC TAT CAG GCC AGC GTC GAC
ala asn ala asn asp gly thr arg ala val gly thr pro gly tyr gln ala ser val asp
122/41                                                152/51
TAT GTG GTA AAC ACA CTG CGC AAC AGC GGT TTT GAT GTG CAA ACC CCG GAG TTC TCC GCT
tyr val val asn thr leu arg asn ser gly phe asp val gln thr pro glu phe ser ala
182/61                                                212/71
CGC GTG TTC AAG GCC GAA AAA GGG GTG GTG ACC CTC GGC GGC AAC ACC GTG GAG GCG AGG
arg val phe lys ala glu lys gly val val thr leu gly gly asn thr val glu ala arg
242/81                                                272/91
GCG CTC GAG TAC AGC CTC GGC ACA CCG CCG GAC GGG GTG ACG GGC CCG CTG GTG GCT GCC
ala leu glu tyr ser leu gly thr pro pro asp gly val thr gly pro leu val ala ala
302/101                                               332/111
CCC GCC GAC GAC AGT CCG GGC TGC AGT CCG TCG GAC TAC GAC AGG CTG CCG GTG TCC GGT
pro ala asp asp ser pro gly cys ser pro ser asp tyr asp arg leu pro val ser gly
362/121
GCG GTG GTG CTG GTA GAT C
ala val val leu val asp)
```

SEQ ID NOS: 410-411

FIG. 19B

```
      SEQ ID NO: 412      SEQ ID NO: 414      33/11
TGC GCA ACG GGG TGA GCA CCG ACG CGA TGA TGG CGC AAC TAT CGA AAC TGC AGG ACA TCG
(cys ala thr gly)OPA(ala pro thr arg)OPA(trp arg asn tyr arg asn cys arg thr ser
 63/21     SEQ ID NO: 413   SEQ ID NO: 415  93/31
CCA ACG CCA ACG ACG GCA CTC GCG CGG TGG GCA CCC CTG GCT ATC AGG CCA GCG TCG ACT
pro thr pro thr thr ala leu ala arg trp ala pro leu ala ile arg pro ala ser thr
123/41                                    153/51
ATG TGG TAA ACA CAC TGC GCA ACA GCG GTT TTG ATG TGC AAA CCC CGG AGT TCT CCG CTC
met trp)OCH(thr his cys ala thr ala val leu met cys lys pro arg ser ser pro leu
183/61          SEQ ID NO: 416             213/71
GCG TGT TCA AGG CCG AAA AAG GGG TGG TGA CCC TCG GCG GCA ACC TGG AGG CGA GGG
ala cys ser arg pro lys lys gly trp)OPA(pro ser ala ala thr pro trp arg arg gly
243/81           SEQ ID NO: 417           273/91
CGC TCG AGT ACA GCC TCG GCA CAC CGC CGG ACG GGG TGA CGG GCC CGC TGG TGG CTG CCC
arg ser ser thr ala ser ala his arg arg thr gly)OPA(arg ala arg trp trp leu pro
303/101                                   333/111      SEQ ID NO: 418
CCG CCG ACG ACA GTC CGG GCT GCA GTC CGT CGG ACT ACG ACA GGC TGC CGG TGT CCG GTG
pro pro thr thr val arg ala ala val arg arg thr thr thr gly cys arg cys pro val
363/121
CGG TGG TGC TGG TAG ATC
arg trp cys trp)AMB ile
```

SEQ ID NOS:412-418

FIG. 19C part of the nucleotide sequence of seq19A

```
1/1    SEQ ID NO: 419                 31/11
CTA TCG AAA CTG CAG GAC ATC GCC AAC GCC AAC GAC GGC ACT CGC GCG GTG GGC ACC CCT
(leu ser lys leu gln asp ile ala asn ala asn asp gly thr arg ala val gly thr pro
 61/21   SEQ ID NO: 420                91/31
GGC TAT CAG GCC AGC GTC GAC TAT GTG GTA AAC ACA CTG CGC AAC AGC GGT TTT GAT GTG
gly tyr gln ala ser val asp tyr val val asn thr leu arg asn ser gly phe asp val
121/41                                151/51
CAA ACC CCG GAG TTC TCC GCT CGC GTG TTC AAG GCC GAA AAA GGG GTG GTG ACC CTC GGC
gln thr pro glu phe ser ala arg val phe lys ala glu lys gly val val thr leu gly
181/61                                211/71
GGC AAC ACC GTG GAG GCG AGG GCG CTC GAG TAC AGC CTC GGC ACA CCG CCG GAC GGG GTG
gly asn thr val glu ala arg ala leu glu tyr ser leu gly thr pro pro asp gly val
241/81                                271/91
ACG GGC CCG CTG GTG GCT GCC CCC GCC GAC GAC AGT CCG GGC TGC AGT CCG TCG GAC TAC
thr gly pro leu val ala ala pro ala asp asp ser pro gly cys ser pro ser asp tyr
301/101                               331/111
GAC AGG CTG CCG GTG TCC GGT GCG GTG GTG CTG GTA GAT C
asp arg leu pro val ser gly ala val val leu val asp)
```

SEQ ID No419-420

FIG. 19A'

1/1 SEQ ID NO: 421                               31/11
TAT CGA AAC TGC AGG ACA TCG CCA ACG CCA ACG ACG GCA CTC GCG CGG TGG GCA CCC CTG
(tyr arg asn cys arg thr ser pro thr pro thr thr ala leu ala arg trp ala pro leu
61/21   SEQ ID NO: 422                           91/31
GCT ATC AGG CCA GCG TCG ACT ATG TGG TAA ACA CAC TGC GCA ACA GCG GTT TTG ATG TGC
ala ile arg pro ala ser thr met trp)OCH(thr his cys ala thr ala val leu met cys
121/41                       SEQ ID NO: 423  151/51
AAA CCC CGG AGT TCT CCG CTC GCG TGT TCA AGG CCG AAA AAG GGG TGG TGA CCC TCG GCG
lys pro arg ser ser pro leu ala cys ser arg pro lys lys gly trp)OPA(pro ser ala
181/61                                           211/71    SEQ ID NO: 424
GCA ACA CCG TGG AGG CGA GGG CGC TCG AGT ACA GCC TCG GCA CAC CGC CGG ACG GGG TGA
ala thr pro trp arg arg gly arg ser ser thr ala ser ala his arg arg thr gly)OPA
241/81                                           271/91
CGG GCC CGC TGG TGG CTG CCC CCG CCG ACG ACA GTC CGG GCT GCA GTC CGT CGG ACT ACG
(arg ala arg trp trp leu pro pro pro thr thr val arg ala ala val arg arg thr thr
301/101  SEQ ID NO: 425                          331/111
ACA GGC TGC CGG TGT CCG GTG CGG TGG TGC TGG TAG ATC
thr gly cys arg cys pro val arg trp cys trp)AMB ile

SEQ ID NOS:421-425

FIG. 19B'

1/1   SEQ ID NO: 426                             31/11
ATC GAA ACT GCA GGA CAT CGC CAA CGC CAA CGA CGG CAC TCG CGC GGT GGG CAC CCC TGG
(ile glu thr ala gly his arg gln arg gln arg arg his ser arg gly gly his pro trp
61/21   SEQ ID NO: 427                           91/31
CTA TCA GGC CAG CGT CGA CTA TGT GGT AAA CAC ACT GCG CAA CAG CGG TTT TGA TGT GCA
leu ser gly gln arg arg leu cys gly lys his thr ala gln gln arg phe)OPA(cys ala
121/41                                           151/51    SEQ ID NO: 428
AAC CCC GGA GTT CTC GCG TCG CGT GTT CAA GGC CGA AAA AGG GGT GGT GAC CCT CGG CGG
asn pro gly val leu arg ser arg val gln gly arg lys arg gly gly asp pro arg arg
181/61                                           211/71
CAA CAC CGT GGA GGC GAG GGC GCT CGA GTA CAG CCT CGG CAC ACC GCC GGA CGG GGT GAC
gln his arg gly gly glu gly ala arg val gln pro arg his thr ala gly arg gly asp
241/81                                           271/91
GGG CCC GCT GGT GGC TGC CCC GCC GAC GAC AGT CCG GGC TGC AGT CCG TCG GAC TAC GA
gly pro ala gly gly cys pro arg arg arg gln ser gly leu gln ser val gly leu arg
301/101                                          331/111
CAG GCT GCC GGT GTC CGG TGC GGT GGT GCT GGT AGA TC
gln ala ala gly val arg cys gly gly ala gly arg)

SEQ ID NOS:426-428

FIG. 19C' sequence Rv0418 predicted by Cole et al. (Nature 393:537-544) and
containing seq19A'

```
1/1    SEQ ID NO: 429                          31/11
atg gtg aac aaa tcc agg atg atg ccg gcg gtg ctg gcc gtg gct gtg gtc gtc gca ttc
(Met val asn lys ser arg met met pro ala val leu ala val ala val val val ala phe
61/21    SEQ ID NO: 430                        91/31
ctg acg acg ggc tgt atc cgg tgg tct acg cag tcg cgg ccc gtt gtt aac ggc ccc gct
leu thr thr gly cys ile arg trp ser thr gln ser arg pro val val asn gly pro ala
121/41                                         151/51
gcc gca gag ttc gcc gtt gcg ttg cgc aac cgg gtg agc acc gac gcg atg atg gcg cac
ala ala glu phe ala val ala leu arg asn arg val ser thr asp ala met met ala his
181/61                                         211/71
cta tcg aaa ctg cag gac atc gcc aac gcc aac gac ggc act cgc gcg gtg ggc acc cct
leu ser lys leu gln asp ile ala asn ala asn asp gly thr arg ala val gly thr pro
241/81                                         271/91
ggc tat cag gcc agc gtc gac tat gtg gta aac aca ctg cgc aac agc ggt ttt gat gtg
gly tyr gln ala ser val asp tyr val val asn thr leu arg asn ser gly phe asp val
301/101                                        331/111
caa acc ccg gag ttc tcc gct cgc gtg ttc aag gcc gaa aaa ggg gtg gtg acc ctc ggc
gln thr pro glu phe ser ala arg val phe lys ala glu lys gly val val thr leu gly
361/121                                        391/131
ggc aac acc gtg gag gcg agg gcg ctc gag tac agc ctc ggc aca ccg ccg gac ggg gtg
gly asn thr val glu ala arg ala leu glu tyr ser leu gly thr pro pro asp gly val
421/141                                        451/151
acg ggc ccg ctg gtg gct gcc ccc gcc gac gac agt ccg ggc tgc agt ccg tcg gac tac
thr gly pro leu val ala ala pro ala asp asp ser pro gly cys ser pro ser asp tyr
481/161                                        511/171
gac agg ctg ccg gtg tcc ggt gcg gtg gtg ctg gta gat cgc ggc gtc tgt cct ttt gcc
asp arg leu pro val ser gly ala val val leu val asp arg gly val cys pro phe ala
541/181                                        571/191
cag aag gaa gac gca gcc gcg cag cgc ggt gcg gtg gcg ctg atc att gct gac aac atc
gln lys glu asp ala ala ala gln arg gly ala val ala leu ile ile ala asp asn ile
601/201                                        631/211
gac gag cag gcg atg ggc ggc acc ctg ggg gct aat acc gac gtc aag atc ccg gtg gtg
asp glu gln ala met gly gly thr leu gly ala asn thr asp val lys ile pro val val
661/221                                        691/231
agt gtc acc aag tcg gtc gga ttc cag cta cgc gga cag tct ggg cca acc acc gtc aag
ser val thr lys ser val gly phe gln leu arg gly gln ser gly pro thr thr val lys
721/241                                        751/251
ctc acg gcg agc acc caa agt ttc aag gcc cgc aac gtc atc gcg cag acg aag acg ggg
leu thr ala ser thr gln ser phe lys ala arg asn val ile ala gln thr lys thr gly
781/261                                        811/271
tcg tcg gcc aac gtg gtg atg gca ggt gcg cat ttg gac agc gtt ccg gaa gga ccc ggc
ser ser ala asn val val met ala gly ala his leu asp ser val pro glu gly pro gly
841/281                                        871/291
atc aac gac aac ggc tcg gga gtg gct gcg gtt ctg gaa acg gca gtg cag ctg ggg aac
ile asn asp asn gly ser gly val ala ala val leu glu thr ala val gln leu gly asn
901/301                                        931/311
tca ccg cat gtg tcc aac gcg gta cgg ttc gcc ttc tgg ggc gcc gag gaa ttc ggc ctg
ser pro his val ser asn ala val arg phe ala phe trp gly ala glu glu phe gly leu
961/321                                        991/331
att ggg tca cga aac tac gtc gag tcg ctg gac atc gac gcg ctc aaa ggc atc gcg ctg
ile gly ser arg asn tyr val glu ser leu asp ile asp ala leu lys gly ile ala leu
```

SEQ ID NOS:429-430

FIG. 19D

```
1021/341                                          1051/351
tat ctg aac ttc gac atg ttg gcg tcg ccg aac ccg ggt tac ttc acc tac gac ggt gac
tyr leu asn phe asp met leu ala ser pro asn pro gly tyr phe thr tyr asp gly asp
1081/361                                          1111/371
cag tcg ctg ccg cta gac gcc cgc ggt cag ccg gtg gtg ccc gaa ggc tcg gcc ggt atc
gln ser leu pro leu asp ala arg gly gln pro val val pro glu gly ser ala gly ile
1141/381                                          1171/391
gag cgc acg ttc gtc gcc tat ctg aag atg gcc ggc aag acc gcg cag gac acc tcg ttc
glu arg thr phe val ala tyr leu lys met ala gly lys thr ala gln asp thr ser phe
1201/401                                          1231/411
gac ggt cgg tcc gac tac gac ggc ttc acg ctg gcg ggt atc cct tcg ggt ggc ctg ttc
asp gly arg ser asp tyr asp gly phe thr leu ala gly ile pro ser gly gly leu phe
1261/421                                          1291/431
tcc ggc gct gag gtc aag aag tcc gcc gag caa gcc gag ctc tgg ggc ggc acc gcc gac
ser gly ala glu val lys lys ser ala glu gln ala glu leu trp gly gly thr ala asp
1321/441                                          1351/451
gag cct ttc gat ccc aac tat cac cag aag aca gac acc ctg gac cat atc gac cgc acc
glu pro phe asp pro asn tyr his gln lys thr asp thr leu asp his ile asp arg thr
1381/461                                          1411/471
gcg ctc ggt atc aac ggc gct ggc gtc gcg tac gcg gtg ggt ttg tat gcg cag gac ctc
ala leu gly ile asn gly ala gly val ala tyr ala val gly leu tyr ala gln asp leu
1441/481                                          1471/491
ggc ggc ccc aac ggg gtt ccg gtc atg gcg gac cgc acc cgc cac ctg att gcc aaa ccg
gly gly pro asn gly val pro val met ala asp arg thr arg his leu ile ala lys pro)
1501/501
tga
OPA
```

SEQ ID NOS: 429-430 (continued)

FIG. 19D (continued)

ORF according to Cole et al. (Nature 393:537-544) and containing Rv0418

```
1/1   ─SEQ ID NO: 431                        31/11
tag gcc att caa cgc tct gtt cgt ttg att ggt cgg tgg gat gcg aaa gct gcg cgg cga
AMB(ala ile gln arg ser val arg leu ile gly arg trp asp ala lys ala ala arg arg
61/21  ─SEQ ID NO: 432                       91/31
cag gcg cgg tct aat ctg ggc gcg atg gtg aac aaa tcc agg atg atg ccg gcg gtg ctg
gln ala arg ser asn leu gly ala met val asn lys ser arg met met pro ala val leu
121/41                                       151/51
gcc gtg gct gtg gtc gtc gca ttc ctg acg acg ggc tgt atc cgg tgg tct acg cag tcg
ala val ala val val val ala phe leu thr thr gly cys ile arg trp ser thr gln ser
181/61                                       211/71
cgg ccc gtt gtt aac ggc ccc gct gcc gca gag ttc gcc gtt gcg ttg cgc aac cgg gtg
arg pro val val asn gly pro ala ala ala glu phe ala val ala leu arg asn arg val
241/81                                       271/91
agc acc gac gcg atg atg gcg cac cta tcg aaa ctg cag gac atc gcc aac gcc aac gac
ser thr asp ala met met ala his leu ser lys leu gln asp ile ala asn ala asn asp
301/101                                      331/111
ggc act cgc gcg gtg ggc acc cct ggc tat cag gcc agc gtc gac tat gtg gta aac aca
gly thr arg ala val gly thr pro gly tyr gln ala ser val asp tyr val val asn thr
361/121                                      391/131
ctg cgc aac agc ggt ttt gat gtg caa acc ccg gag ttc tcc gct cgc gtg ttc aag gcc
leu arg asn ser gly phe asp val gln thr pro glu phe ser ala arg val phe lys ala
421/141                                      451/151
gaa aaa ggg gtg gtg acc ctc ggc ggc aac acc gtg gag gcg agg gcg ctc gag tac agc
glu lys gly val val thr leu gly gly asn thr val glu ala arg ala leu glu tyr ser
481/161                                      511/171
ctc ggc aca ccg ccg gac ggg gtg acg ggc ccg ctg gtg gct gcc ccc gcc gac gac agt
leu gly thr pro pro asp gly val thr gly pro leu val ala ala pro ala asp asp ser
541/181                                      571/191
ccg ggc tgc agt ccg tcg gac tac gac agg ctg ccg gtg tcc ggt gcg gtg gtg ctg gta
pro gly cys ser pro ser asp tyr asp arg leu pro val ser gly ala val val leu val
601/201                                      631/211
gat cgc ggc gtc tgt cct ttt gcc cag aag gaa gac gca gcc gcg cag cgc ggt gcg gtg
asp arg gly val cys pro phe ala gln lys glu asp ala ala ala gln arg gly ala val
661/221                                      691/231
gcg ctg atc att gct gac aac atc gac gag cag gcg atg ggc ggc acc ctg ggg gct aat
ala leu ile ile ala asp asn ile asp glu gln ala met gly gly thr leu gly ala asn
721/241                                      751/251
acc gac gtc aag atc ccg gtg gtg agt gtc acc aag tcg gtc gga ttc cag cta cgc gga
thr asp val lys ile pro val val ser val thr lys ser val gly phe gln leu arg gly
781/261                                      811/271
cag tct ggg cca acc acc gtc aag ctc acg gcg agc acc caa agt ttc aag gcc cgc aac
gln ser gly pro thr thr val lys leu thr ala ser thr gln ser phe lys ala arg asn
841/281                                      871/291
gtc atc gcg cag acg aag acg ggg tcg tcg gcc aac gtg gtg atg gca ggt gcg cat ttg
val ile ala gln thr lys thr gly ser ser ala asn val val met ala gly ala his leu
901/301                                      931/311
gac agc gtt ccg gaa gga ccc ggc atc aac gac aac ggc tcg gga gtg gct gcg gtt ctg
asp ser val pro glu gly pro gly ile asn asp asn gly ser gly val ala ala val leu
961/321                                      991/331
gaa acg gca gtg cag ctg ggg aac tca ccg cat gtg tcc aac gcg gta cgg ttc gcc ttc
glu thr ala val gln leu gly asn ser pro his val ser asn ala val arg phe ala phe
```

SEQ ID NOS:431-432

FIG. 19E

```
1021/341
tgg ggc gcc gag gaa ttc ggc ctg att ggg
trp gly ala glu glu phe gly leu ile gly
1081/361
gac gcg ctc aaa ggc atc gcg ctg tat ctg
asp ala leu lys gly ile ala leu tyr leu
1141/381
ggt tac ttc acc tac gac ggt gac cag tcg
gly tyr phe thr tyr asp gly asp gln ser
1201/401
gtg ccc gaa ggc tcg gcc ggt atc gag cgc
val pro glu gly ser ala gly ile glu arg
1261/421
aag acc gcg cag gac acc tcg ttc gac ggt
lys thr ala gln asp thr ser phe asp gly
1321/441
ggt atc cct tcg ggt ggc ctg ttc tcc ggc
gly ile pro ser gly gly leu phe ser gly
1381/461
gag ctc tgg ggc ggc acc gcc gac gag cct
glu leu trp gly gly thr ala asp glu pro
1441/481
acc ctg gac cat atc gac cgc acc gcg ctc
thr leu asp his ile asp arg thr ala leu
1501/501
gtg ggt ttg tat gcg cag gac ctc ggc ggc
val gly leu tyr ala gln asp leu gly gly
1561/521
acc cgc cac ctg att gcc aaa ccg tga
thr arg his leu ile ala lys pro)OPA 1051/351
tca cga aac tac gtc gag tcg ctg gac atc
ser arg asn tyr val glu ser leu asp ile
1111/371
aac ttc gac atg ttg gcg tcg ccg aac ccg
asn phe asp met leu ala ser pro asn pro
1171/391
ctg ccg cta gac gcc cgc ggt cag ccg gtg
leu pro leu asp ala arg gly gln pro val
1231/411
acg ttc gtc gcc tat ctg aag atg gcc ggc
thr phe val ala tyr leu lys met ala gly
1291/431
cgg tcc gac tac gac ggc ttc acg ctg gcg
arg ser asp tyr asp gly phe thr leu ala
1351/451
gct gag gtc aag aag tcc gcc gag caa gcc
ala glu val lys lys ser ala glu gln ala
1411/471
ttc gat ccc aac tat cac cag aag aca gac
phe asp pro asn tyr his gln lys thr asp
1471/491
ggt atc aac ggc gct ggc gtc gcg tac gcg
gly ile asn gly ala gly val ala tyr ala
1531/511
ccc aac ggg gtt ccg gtc atg gcg gac cgc
pro asn gly val pro val met ala asp arg
```

SEQ ID NOS:431-432 (continued)

FIG. 19E (continued)

```
       SEQ ID NO: 433                              31/11
CGA GAC AGT GGT GCG GGA CAC TTG AGT TCG GCT GCT AAC GAC GCC AGA GTC GCC CGC TTC
(arg asp ser gly ala gly his leu ser ser ala ala asn asp ala arg val ala arg phe
61/21      SEQ ID NO: 434                         91/31
CGC GGT GTG GGA CTC ACG TTC GGT GAG GGT ACA GCG GAC CTT CGA GCA CGC AAT ATC GTG
arg gly val gly leu thr phe gly glu gly thr ala asp leu arg ala arg asn ile val
121/41                                            151/51
GGC CGG CTG GCA ACC GTC GGT TTC GAC GTT GGT GAC GAC CCC TCG TTC ATG AAT CGT TCT
gly arg leu ala thr val gly phe asp val gly asp asp pro ser phe met asn arg ser)
181/61                                            211/71
TGA GCT CCC CGT TTT GCT GGA TGC CCA GGC ACC GCC GGT ACT GCT GCG CTT AAG CTT GTC
OPA(ala pro arg phe ala gly cys pro gly thr ala gly thr ala ala leu lys leu val
241/81     SEQ ID NO: 435                         271/91
GCA CAT GGT GCC GGC AGG GAG GAA CAG TGG GCA AGC AGC TAG CCG CGC TCG CCG CGC TGG
ala his gly ala gly arg glu glu gln trp ala ser ser)AMB(pro arg ser pro arg trp
301/101                                           331/111       SEQ ID NO: 436
TCG GTG CGT GCA TGC TCG CAG CCG GAT GCA CCA ACG TGG TCG ACG GGA CCG CCG TGG CTG
ser val arg ala cys ser gln pro asp ala pro thr trp ser thr gly pro pro trp leu
361/121
CCG ACA AAT CCG GAC CAC TGC ATC AGG ATC
pro thr asn pro asp his cys ile arg ile)
```

SEQ ID NOS:433-436

FIG. 20A

```
                SEQ ID NO: 437      SEQ ID NO: 439      32/11
GAG ACA GTG GTG CGG GAC ACT TGA GTT CGG CTG CTA ACG ACG CCA GAG TCG CCC GCT TCC
(glu thr val val arg asp thr)OPA(val arg leu leu thr thr pro glu ser pro ala ser
62/21         SEQ ID NO: 438                           92/31
GCG GTG TGG GAC TCA CGT TCG GTG AGG GTA CAG CGG ACC TTC GAG CAC GCA ATA TCG TGG
ala val trp asp ser arg ser val arg val gln arg thr phe glu his ala ile ser trp
122/41                                                 152/51
GCC GGC TGG CAA CCG TCG GTT TCG ACG TTG GTG ACG ACC CCT CGT TCA TGA ATC GTT CTT
ala gly trp gln pro ser val ser thr leu val thr thr pro arg ser)OPA(ile val leu
182/61                                                 212/71    SEQ ID NO: 440
GAG CTC CCC GTT TTG CTG GAT GCC CAG GCA CCG CCG GTA CTG CTG CGC TTA AGC TTG TCG
glu leu pro val leu leu asp ala gln ala pro pro val leu leu arg leu ser leu ser
242/81                                                 272/91
CAC ATG GTG CCG GCA GGG AGG AAC AGT GGG CAA GCA GCT AGC CGC GCT CGC CGC GCT GGT
his met val pro ala gly arg asn ser gly gln ala ala ser arg ala arg arg ala gly
302/101                                                332/111
CGG TGC GTG CAT GCT CGC AGC CGG ATG CAC CAA CGT GGT CGA CGG GAC CGC CGT GGC TGC
arg cys val his ala arg ser arg met his gln arg gly arg arg asp arg arg gly cys
362/121
CGA CAA ATC CGG ACC ACT GCA TCA GGA TC
arg gln ile arg thr thr ala ser gly)

SEQ ID NOS:437-440

FIG. 20B

SEQ ID NO: 441                        33/11
AGA CAG TGG TGC GGG ACA CTT GAG TTC GGC TGC TAA CGA CGC CAG AGT CGC CCG CTT CCG
(arg gln trp cys gly thr leu glu phe gly cys)OCH(arg arg gln ser arg pro leu pro
63/21         SEQ ID NO: 442                           93/31      SEQ ID NO: 443
CGG TGT GGG ACT CAC GTT CGG TGA GGG TAC AGC GGA CCT TCG AGC ACG CAA TAT CGT GGG
arg cys gly thr his val arg)OPA(gly tyr ser gly pro ser ser thr gln tyr arg gly
123/41                SEQ ID NO: 444                   153/51
CCG GCT GGC AAC CGT CGG TTT CGA CGT TGG TGA CGA CCC CTC GTT CAT GAA TCG TTC TTG
pro ala gly asn arg arg phe arg arg trp)OPA(arg pro leu val his glu ser phe leu
183/61                                                 213/71       SEQ ID NO: 445
AGC TCC CCG TTT TGC TGG ATG CCC AGG CAC CGC GGT ACT GCT GCG CTT AAG CTT GTC GC
ser ser pro phe cys trp met pro arg his arg gly tyr cys cys ala)OCH(ala cys arg
243/81                                                 273/91     SEQ ID NO: 446
ACA TGG TGC CGG CAG GGA GGA ACA GTG GGC AAG CAG CTA GCC GCG CTC GCC GCG CTG GTC
thr trp cys arg gln gly gly thr val gly lys gln leu ala ala leu ala ala leu val
303/101                                                333/111
GGT GCG TGC ATG CTC GCA GCC GGA TGC ACC AAC GTG GTC GAC GGG ACC GCC GTG GCT GCC
gly ala cys met leu ala ala gly cys thr asn val val asp gly thr ala val ala ala
363/121
GAC AAA TCC GGA CCA CTG CAT CAG GAT C
asp lys ser gly pro leu his gln asp)

SEQ ID NOS:441-446

FIG. 20C
``` part of the nucleotide sequence of seq20A

```
1/1    SEQ ID NO: 447      SEQ ID NO: 449    31/11
TGT GGG ACT CAC GTT CGG TGA GGG TAC AGC GGA CCT TCG AGC ACG CAA TAT CGT GGG CCG
(cys gly thr his val arg)OPA(gly tyr ser gly pro ser ser thr gln tyr arg gly pro
61/21   SEQ ID NO: 448                        91/31
GCT GGC AAC CGT CGG TTT CGA CGT TGG TGA CGA CCC CTC GTT CAT GAA TCG TTC TTG AGC
ala gly asn arg arg phe arg arg trp)OPA(arg pro leu val his glu ser phe leu ser
121/41               SEQ ID NO: 450    151/51
TCC CCG TTT TGC TGG ATG CCC AGG CAC CGC CGG TAC TGC TGC GCT TAA GCT TGT CGC ACA
ser pro phe cys trp met pro arg his arg arg tyr cys cys ala)OCH(ala cys arg thr
181/61                             211/71    SEQ ID NO: 451
TGG TGC CGG CAG GGA GGA ACA GTG GGC AAG CAG CTA GCC GCG CTC GCC GCG CTG GTC GGT
trp cys arg gln gly gly thr val gly lys gln leu ala ala leu ala ala leu val gly
241/81                                        271/91
GCG TGC ATG CTC GCA GCC GGA TGC ACC AAC GTG GTC GAC GGG ACC GCC GTG GCT GCC GAC
ala cys met leu ala ala gly cys thr asn val val asp gly thr ala val ala ala asp
301/101
AAA TCC GGA CCA CTG CAT CAG GAT C
lys ser gly pro leu his gln asp)
```

SEQ ID NOS:447-451

FIG. 20A'

```
1/1   SEQ ID NO: 452                         31/11
GTG GGA CTC ACG TTC GGT GAG GGT ACA GCG GAC CTT CGA GCA CGC AAT ATC GTG GGC CGG
(val gly leu thr phe gly glu gly thr ala asp leu arg ala arg asn ile val gly arg
61/21   SEQ ID NO: 453                        91/31
CTG GCA ACC GTC GGT TTC GAC GTT GGT GAC GAC CCC TCG TTC ATG AAT CGT TCT TGA GCT
leu ala thr val gly phe asp val gly asp asp pro ser phe met asn arg ser)OPA(ala
121/41                             151/51    SEQ ID NO: 454
CCC CGT TTT GCT GGA TGC CCA GGC ACC GCC GGT ACT GCT GCG CTT AAG CTT GTC GCA CAT
pro arg phe ala gly cys pro gly thr ala gly thr ala ala leu lys leu val ala his
181/61                                        211/71
GGT GCC GGC AGG GAG GAA CAG TGG GCA AGC AGC TAG CCG CGC TCG CCG CGC TGG TCG GTG
gly ala gly arg glu glu gln trp ala ser ser)AMB(pro arg ser pro arg trp ser val
241/81                             271/91    SEQ ID NO: 455
CGT GCA TGC TCG CAG CCG GAT GCA CCA ACG TGG TCG ACG GGA CCG CCG TGG CTG CCG ACA
arg ala cys ser gln pro asp ala pro thr trp ser thr gly pro pro trp leu pro thr
301/101
AAT CCG GAC CAC TGC ATC AGG ATC
asn pro asp his cys ile arg ile)
```

SEQ ID NOS:452-455

FIG. 20B'

```
1/1    SEQ ID NO: 456                          31/11
GTG TGG GAC TCA CGT TCG GTG AGG GTA CAG  CGG ACC TTC GAG CAC GCA ATA TCG TGG GCC
(val trp asp ser arg ser val arg val gln  arg thr phe glu his ala ile ser trp ala
61/21    SEQ ID NO: 457                      91/31
GGC TGG CAA CCG TCG GTT TCG ACG TTG GTG  ACG ACC CCT CGT TCA TGA ATC GTT CTT GAG
gly trp gln pro ser val ser thr leu val  thr thr pro arg ser)OPA(ile val leu glu
121/41                                     151/51   SEQ ID NO: 458
CTC CCC GTT TTG CTG GAT GCC CAG GCA CCG  CCG GTA CTG CTG CGC TTA AGC TTG TCG CAC
leu pro val leu leu asp ala gln ala pro  pro val leu leu arg leu ser leu ser his
181/61                                     211/71
ATG GTG CCG GCA GGG AGG AAC AGT GGG CAA  GCA GCT AGC CGC GCT CGC CGC GCT GGT CGG
met val pro ala gly arg asn ser gly gln  ala ala ser arg ala arg arg ala gly arg
241/81                                     271/91
TGC GTG CAT GCT CGC AGC CGG ATG CAC CAA  CGT GGT CGA CGG GAC CGC CGT GGC TGC CGA
cys val his ala arg ser arg met his gln  arg gly arg arg asp arg arg gly cys arg
301/101
CAA ATC CGG ACC ACT GCA TCA GGA TC
gln ile arg thr thr ala ser gly)
```

SEQ ID NOS:456-458

FIG. 20C' sequence Rv3576 predicted by Cole et al. (Nature 393:537-544) and containing seq20A'

```
1/1    SEQ ID NO: 459                          31/11
atg ggc aag cag cta gcc gcg ctc gcc gcg  ctg gtc ggt gcg tgc atg ctc gca gcc gga
(met gly lys gln leu ala ala leu ala ala  leu val gly ala cys met leu ala ala gly
61/21    SEQ ID NO: 460                      91/31
tgc acc aac gtg gtc gac ggg acc gcc gtg  gct gcc gac aaa tcc gga cca ctg cat cag
cys thr asn val val asp gly thr ala val  ala ala asp lys ser gly pro leu his gln
121/41                                     151/51
gat ccg ata ccg gtt tca gcg ctt gaa ggg  ctg ctc ctc gac ttg agc cag atc aat gcc
asp pro ile pro val ser ala leu glu gly  leu leu leu asp leu ser gln ile asn ala
181/61                                     211/71
gcg ctg ggt gcg aca tcg atg aag gtg tgg  ttc aac gcc aag gca atg tgg gac tgg agc
ala leu gly ala thr ser met lys val trp  phe asn ala lys ala met trp asp trp ser
241/81                                     271/91
aag agc gtg gcc gac aag aat tgc ctg gct  atc gac ggt cca gca cag gaa aag gtc tat
lys ser val ala asp lys asn cys leu ala  ile asp gly pro ala gln glu lys val tyr
301/101                                    331/111
gcc ggc acc ggg tgg acc gct atg cgc ggc  caa cgg ctg gat gac agc atc gat gac tcc
ala gly thr gly trp thr ala met arg gly  gln arg leu asp asp ser ile asp asp ser
361/121                                    391/131
aag aaa cgc gac cac tac gcc att caa gcg  gtc gtc ggc ttc ccg acc gca cat gat gcc
lys lys arg asp his tyr ala ile gln ala  val val gly phe pro thr ala his asp ala
421/141                                    451/151
gag gag ttc tac agc tcc tcg gtg caa agc  tgg agc agc tgc tcg aac cgc cgg ttt gtc
glu glu phe tyr ser ser ser val gln ser  trp ser ser cys ser asn arg arg phe val
481/161                                    511/171
gaa gtc acc ccc gga cag gac gac gcc gcc  tgg act gtg gct gac gtt gtc aac gac aac
glu val thr pro gly gln asp asp ala ala  trp thr val ala asp val val asn asp asn
541/181                                    571/191
ggc atg ctc agt agc tcg cag gtt cag gaa  ggc ggc gac gga tgg acc tgc cag cgt gcc
gly met leu ser ser ser gln val gln glu  gly gly asp gly trp thr cys gln arg ala
601/201                                    631/211
ctg act gcg cgc aac aac gtc act atc gac  att gtc acg tgc gcc tat agc caa ccg gat
leu thr ala arg asn asn val thr ile asp  ile val thr cys ala tyr ser gln pro asp
661/221                                    691/231
ttg gtg gcg att ggc atc gct aac caa atc  gcg gcc aag gtt gct aag cag tag
leu val ala ile gly ile ala asn gln ile  ala ala lys val ala lys gln)AMB
```

SEQ ID NOS:459-460

FIG. 20D

ORF according to Cole et al. (Nature 393:537-544) and containing Rv3576

```
1/1    SEQ ID NO: 461                    31/11
taa gct tgt cgc aca tgg tgc cgg cag gga gga aca gtg ggc aag cag cta gcc gcg ctc
OCH(ala cys arg thr trp cys arg gln gly gly thr val gly lys gln leu ala ala leu
61/21    SEQ ID NO: 462                  91/31
gcc gcg ctg gtc ggt gcg tgc atg ctc gca gcc gga tgc acc aac gtg gtc gac ggg acc
ala ala leu val gly ala cys met leu ala ala gly cys thr asn val val asp gly thr
121/41                                   151/51
gcc gtg gct gcc gac aaa tcc gga cca ctg cat cag gat ccg ata ccg gtt tca gcg ctt
ala val ala ala asp lys ser gly pro leu his gln asp pro ile pro val ser ala leu
181/61                                   211/71
gaa ggg ctg ctt ctc gac ttg agc cag atc aat gcc gcg ctg ggt gcg aca tcg atg aag
glu gly leu leu leu asp leu ser gln ile asn ala ala leu gly ala thr ser met lys
241/81                                   271/91
gtg tgg ttc aac gcc aag gca atg tgg gac tgg agc aag agc gtg gcc gac aag aat tgc
val trp phe asn ala lys ala met trp asp trp ser lys ser val ala asp lys asn cys
301/101                                  331/111
ctg gct atc gac ggt cca gca cag gaa aag gtc tat gcc ggc acc ggg tgg acc gct atg
leu ala ile asp gly pro ala gln glu lys val tyr ala gly thr gly trp thr ala met
361/121                                  391/131
cgc ggc caa cgg ctg gat gac agc atc gat gac tcc aag aaa cgc gac cac tac gcc att
arg gly gln arg leu asp asp ser ile asp asp ser lys lys arg asp his tyr ala ile
421/141                                  451/151
caa gcg gtc gtc ggc ttc ccg acc gca cat gat gcc gag gag ttc tac agc tcc tcg gtg
gln ala val val gly phe pro thr ala his asp ala glu glu phe tyr ser ser ser val
481/161                                  511/171
caa agc tgg agc agc tgc tcg aac cgc cgg ttt gtc gaa gtc acc ccc gga cag gac gac
gln ser trp ser ser cys ser asn arg arg phe val glu val thr pro gly gln asp asp
541/181                                  571/191
gcc gcc tgg act gtg gct gac gtt gtc aac gac aac ggc atg ctc agt agc tcg cag gtt
ala ala trp thr val ala asp val val asn asp asn gly met leu ser ser ser gln val
601/201                                  631/211
cag gaa ggc ggc gac gga tgg acc tgc cag cgt gcc ctg act gcg cgc aac aac gtc act
gln glu gly gly asp gly trp thr cys gln arg ala leu thr ala arg asn asn val thr
661/221                                  691/231
atc gac att gtc acg tgc gcc tat agc caa ccg gat ttg gtg gcg att ggc atc gct aac
ile asp ile val thr cys ala tyr ser gln pro asp leu val ala ile gly ile ala asn
721/241
caa atc gcg gcc aag gtt gct aag cag tag
gln ile ala ala lys val ala lys gln)AMB
```

SEQ ID NOS:461-462

FIG. 20E

1/1 ─SEQ ID NO: 463                               31/11
GTC CTG GTC GCC GCG CAA CTG GCC GGT CCC  GAT GGA AAG TGT TCA CGA TCG CGC TTC TGC
(val leu val ala ala gln leu ala gly pro  asp gly lys cys ser arg ser arg phe cys
61/21 ─SEQ ID NO: 464   SEQ ID NO: 466     91/31
CGC TGG TAG TGG CGA TGG TGT TAG CAG GAT  TGC GGG TCG AGG CTG CGA TGG CCA GCA CCA
arg trp)AMB(trp arg trp cys)AMB(gln asp  cys gly ser arg leu arg trp pro ala pro
121/41           ─SEQ ID NO: 465           151/51
GCG GCC TGC GGC TGG TCG CCG CGC GCG CCG  AAA TGA TAC CCG CGA TCA CGA AAT ACA TGT
ala ala cys gly trp ser pro arg ala pro  lys)OPA(tyr pro arg ser arg asn thr cys
181/61                                     211/71 ─SEQ ID NO: 467
CGG CGC TGG ACG TCG CCG TGC TGG CCA GCT  CGA CCG GAC ACG ATG TGG AGG GGG CGC AGA
arg arg trp thr ser pro cys trp pro ala  arg pro asp thr met trp arg gly arg arg
241/81                                     271/91
AAA ACT TCA CCG CCC GCA AGT ACG AGC TGC  AGA CGC GAC TGG CCG ACA CCG ACG TCA TCG
lys thr ser pro pro ala ser thr ser cys  arg arg asp trp pro thr pro thr ser ser
301/101                                    331/111
CAG ACG TGC GGT CGG GAG TGA ACA CGC TGC  TCA ACG GCG GTC AGG CGC TGC TGG ATA AGA
gln thr cys gly arg glu)OPA(thr arg cys  ser thr ala val arg arg cys trp ile arg
361/121          ─SEQ ID NO: 468
TGC TGG CCG ACA GCA TCG GCT TGC GGG ATC
cys trp pro thr ala ser ala cys gly ile)

SEQ ID NOS:463-468

FIG. 21A

─SEQ ID NO: 469                            32/11
TCC TGG TCG CCG CGC AAC TGG CCG GTC CCG  ATG GAA AGT GTT CAC GAT CGC GCT TCT GCC
(ser trp ser pro arg asn trp pro val pro  met glu ser val his asp arg ala ser ala
62/21 ─SEQ ID NO: 470                      92/31
GCT GGT AGT GGC GAT GGT GTT AGC AGG ATT  GCG GGT CGA GGC TGC GAT GGC CAG CAC CAG
ala gly ser gly asp gly val ser arg ile  ala gly arg gly cys asp gly gln his gln
122/41                                     152/51
CGG CCT GCG GCT GGT CGC CGC GCG CGC CGA  AAT GAT ACC CGC GAT CAC GAA ATA CAT GTC
arg pro ala ala gly arg arg ala arg arg  asn asp thr arg asp his glu ile his val
182/61                                     212/71
GGC GCT GGA CGT CGC CGT GCT GGC AGC TCG  ACC GGA CAC GAT GTG GAG GGG GCA GAA
gly ala gly arg arg arg ala gly gln leu  asp arg thr arg cys gly gly gly ala glu
242/81                                     272/91
AAA CTT CAC CGC CCG CAA GTA CGA GCT GCA  GAC GCG ACT GGC CGA CAC CGA CGT CAT CGC
lys leu his arg pro gln val arg ala ala  asp ala thr gly arg his arg arg his arg
302/101                                    332/111
AGA CGT GCG GTC GGG AGT GAA CAC GCT GCT  CAA CGG CGG TCA GGC GCT GCT GGA TAA GAT
arg arg ala val gly ser glu his ala ala  gln arg arg ser gly ala ala gly)OCH(asp
362/121                                           SEQ ID NO: 471 ─
GCT GGC CGA CAG CAT CGG CTT GCG GGA TC
ala gly arg gln his arg leu ala gly)

SEQ ID NOS:469-471

FIG. 21B

SEQ ID NO: 472                                33/11
CCT GGT CGC CGC GCA ACT GGC CGG TCC CGA TGG AAA GTG TTC ACG ATC GCG CTT CTG CCG
(pro gly arg arg ala thr gly arg ser arg trp lys val phe thr ile ala leu leu pro
63/21  SEEQ ID NO: 473                        93/31
CTG GTA GTG GCG ATG GTG TTA GCA GGA TTG CGG GTC GAG GCT GCG ATG GCC AGC ACC AGC
leu val val ala met val leu ala gly leu arg val glu ala ala met ala ser thr ser
123/41                                        153/51
GGC CTG CGG CTG GTC GCC GCG CGC GCC GAA ATG ATA CCC GCG ATC ACG AAA TAC ATG TCG
gly leu arg leu val ala ala arg ala glu met ile pro ala ile thr lys tyr met ser
183/61                                        213/71
GCG CTG GAC GTC GCC GTG CTG GCC AGC TCG ACC GGA CAC GAT GTG GAG GGG GCG CAG AAA
ala leu asp val ala val leu ala ser ser thr gly his asp val glu gly ala gln lys
243/81                                        273/91
AAC TTC ACC GCC CGC AAG TAC GAG CTG CAG ACG CGA CTG GCC GAC ACC GAC GTC ATC GCA
asn phe thr ala arg lys tyr glu leu gln thr arg leu ala asp thr asp val ile ala
303/101                                       333/111
GAC GTG CGG TCG GGA GTG AAC ACG CTG CTC AAC GGC GGT CAG GCG CTG CTG GAT AAG ATG
asp val arg ser gly val asn thr leu leu asn gly gly gln ala leu leu asp lys met
363/121
CTG GCC GAC AGC ATC GGC TTG CGG GAT C
leu ala asp ser ile gly leu arg asp)

SEQ ID NOS:472-473

FIG. 21C part of the nucleotide sequence of seq21A

1/1   SEQ ID NO: 474                         31/11
ACG ATC GCG CTT CTG CCG CTG GTA GTG GCG ATG GTG TTA GCA GGA TTG CGG GTC GAG GCT
(thr ile ala leu leu pro leu val val ala met val leu ala gly leu arg val glu ala
61/21  SEQ ID NO: 475                        91/31
GCG ATG GCC AGC ACC AGC GGC CTG CGG CTG GTC GCC GCG CGC GCC GAA ATG ATA CCC GCG
ala met ala ser thr ser gly leu arg leu val ala ala arg ala glu met ile pro ala
121/41                                        151/51
ATC ACG AAA TAC ATG TCG GCG CTG GAC GTC GCC GTG CTG GCC AGC TCG ACC GGA CAC GAT
ile thr lys tyr met ser ala leu asp val ala val leu ala ser ser thr gly his asp
181/61                                        211/71
GTG GAG GGG GCG CAG AAA AAC TTC ACC GCC CGC AAG TAC GAG CTG CAG ACG CGA CTG GCC
val glu gly ala gln lys asn phe thr ala arg lys tyr glu leu gln thr arg leu ala
241/81                                        271/91
GAC ACC GAC GTC ATC GCA GAC GTG CGG TCG GGA GTG AAC ACG CTG CTC AAC GGC GGT CAG
asp thr asp val ile ala asp val arg ser gly val asn thr leu leu asn gly gly gln
301/101                                       331/111
GCG CTG CTG GAT AAG ATG CTG GCC GAC AGC ATC GGC TTG CGG GAT C
ala leu leu asp lys met leu ala asp ser ile gly leu arg asp)

SEQ ID NOS:474-475

FIG. 21A'

```
1/1    SEQ ID NO: 476        SEQ ID NO: 478  31/11
CGA TCG CGC TTC TGC CGC TGG TAG TGG CGA TGG TGT TAG CAG GAT TGC GGG TCG AGG CTG
(arg ser arg phe cys arg trp)AMB(trp arg trp cys)AMB(gln asp cys gly ser arg leu
61/21   SEQ ID NO: 477                       91/31          SEQ ID NO: 479
CGA TGG CCA GCA CCA GCG GCC TGC GGC TGG TCG CCG CGC GCG CCG AAA TGA TAC CCG CGA
arg trp pro ala pro ala ala cys gly trp ser pro arg ala pro lys)OPA(tyr pro arg
121/41                                       151/51     SEQ ID NO: 480
TCA CGA AAT ACA TGT CGG CGC TGG ACG TCG CCG TGC TGG CCA GCT CGA CCG GAC ACG ATG
ser arg asn thr cys arg arg trp thr ser pro cys trp pro ala arg pro asp thr met
181/61                                       211/71
TGG AGG GGG CGC AGA AAA ACT TCA CCG CCC GCA AGT ACG AGC TGC AGA CGC GAC TGG CCG
trp arg gly arg arg lys thr ser pro pro ala ser thr ser cys arg arg asp trp pro
241/81                                       271/91
ACA CCG ACG TCA TCG CAG ACG TGC GGT CGG GAG TGA ACA CGC TGC TCA ACG GCG GTC AGG
thr pro thr ser ser gln thr cys gly arg glu)OPA(thr arg cys ser thr ala val arg
301/101                                      331/111      SEQ ID NO: 481
CGC TGC TGG ATA AGA TGC TGG CCG ACA GCA TCG GCT TGC GGG ATC
arg cys trp ile arg cys trp pro thr ala ser ala cys gly ile)

SEQ ID NOS:476-481

FIG. 21B'

1/1    SEQ ID NO: 482                       31/11
CAC GAT CGC GCT TCT GCC GCT GGT AGT GGC GAT GGT GTT AGC AGG ATT GCG GGT CGA GGC
(his asp arg ala ser ala ala gly ser gly asp gly val ser arg ile ala gly arg gly
61/21   SEQ ID NO: 483                       91/31
TGC GAT GGC CAG CAC CAG CGG CCT GCG GCT GGT CGC CGC GCG CGC CGA AAT GAT ACC CGC
cys asp gly gln his gln arg pro ala ala gly arg arg ala arg arg asn asp thr arg
121/41                                       151/51
GAT CAC GAA ATA CAT GTC GGC GCT GGA CGT CGC CGT GCT GGC CAG CTC GAC CGG ACA CGA
asp his glu ile his val gly ala gly arg arg ala gly gln leu asp arg thr arg
181/61                                       211/71
TGT GGA GGG GGC GCA GAA AAA CTT CAC CGC CCG CAA GTA CGA GCT GCA GAC GCG ACT GGC
cys gly gly gly ala glu lys leu his arg pro gln val arg ala ala asp ala thr gly
241/81                                       271/91
CGA CAC CGA CGT CAT CGC AGA CGT GCG GTC GGG AGT GAA CAC GCT GCT CAA CGG CGG TCA
arg his arg arg his arg arg arg ala val gly ser glu his ala ala gln arg arg ser
301/101                                      331/111
GGC GCT GCT GGA TAA GAT GCT GGC CGA CAG CAT CGG CTT GCG GGA TC
gly ala ala gly)OCH(asp ala gly arg gln his arg leu ala gly)
           SEQ ID NO: 484

SEQ ID NOS:482-484

FIG. 21C'
``` sequence Rv3365c predicted by Cole et al. (Nature 393:537-544) and
containing Seq21A'

```
1/1      SEQ ID NO: 485                          31/11
gtg acc atg ttc gcc cgc ccg acc atc ccg gtc gcg gcg gcc gct tct gat att tcc gcc
val thr met phe ala arg pro thr ile pro val ala ala ala ala ser asp ile ser ala
61/21    SEQ ID NO: 486                                     91/31
ccg gct caa ccg gcc cgc ggc aaa cct cag caa cgc ccg ccg tcc tgg tcg ccg cgc aac
pro ala gln pro ala arg gly lys pro gln gln arg pro pro ser trp ser pro arg asn
121/41                                           151/51
tgg ccg gtc cga tgg aaa gtg ttc acg atc gcg ctt ctg ccg ctg gta gtg gcg atg gtg
trp pro val arg trp lys val phe thr ile ala leu leu pro leu val val ala met val
181/61                                           211/71
tta gca gga ttg cgg gtc gag gct gcg atg gcc agc acc agc ggc ctg cgg ctg gtc gcc
leu ala gly leu arg val glu ala ala met ala ser thr ser gly leu arg leu val ala
241/81                                           271/91
gcg cgc gcc gaa atg ata ccc gcg atc acg aaa tac atg tcg gcg ctg gac gtc gcc gtg
ala arg ala glu met ile pro ala ile thr lys tyr met ser ala leu asp val ala val
301/101                                          331/111
ctg gcc agc tcg acc gga cac gat gtg gag ggg gcg cag aaa aac ttc acc gcc cgc aag
leu ala ser ser thr gly his asp val glu gly ala gln lys asn phe thr ala arg lys
361/121                                          391/131
tac gag ctg cag acg cga ctg gcc gac acc gac gtc atc gca gac gtg cgg tcg gga gtg
tyr glu leu gln thr arg leu ala asp thr asp val ile ala asp val arg ser gly val
421/141                                          451/151
aac acg ctg ctc aac ggc ggt cag gcg ctg ctg gat aag gtg ctg gcc gac agc atc ggc
asn thr leu leu asn gly gly gln ala leu leu asp lys val leu ala asp ser ile gly
481/161                                          511/171
ttg cgg gat cgg gtc acc gcc tac gcg ccg ctg ctg ttg acg gcc cag aac gtg att gac
leu arg asp arg val thr ala tyr ala pro leu leu leu thr ala gln asn val ile asp
541/181                                          571/191
gcg tcg gtg cgg gtt gac agc gag caa atc cga acc cag gtg cag ggt ttg agc cga gcc
ala ser val arg val asp ser glu gln ile arg thr gln val gln gly leu ser arg ala
601/201                                          631/211
gtt ggc gcc cgc ggg cag atg acg atg cag gag atc ctg gtg act cgc ggc gcc gac ctt
val gly ala arg gly gln met thr met gln glu ile leu val thr arg gly ala asp leu
661/221                                          691/231
gcc gag ccg caa ctg cgc agc gcg atg gtt acc ctg gcc ggc acc gaa ccc tcg acg ctg
ala glu pro gln leu arg ser ala met val thr leu ala gly thr glu pro ser thr leu
721/241                                          751/251
ttc ggg atg agc gcg gcg ctc ggt gca ggc tcg ccg gac acc aag aac ctg cag cag caa
phe gly met ser ala ala leu gly ala gly ser pro asp thr lys asn leu gln gln gln
781/261                                          811/271
atg gtg acc agg atg gcg atc atg tcc gat ccg gcc gtt gca ctg gtc aac aac cca gag
met val thr arg met ala ile met ser asp pro ala val ala leu val asn asn pro glu
841/281                                          871/291
ctg ctg cac tcg ata cag atc acc cgc gac att gcc gag cag gtg atc acc gac acc acc
leu leu his ser ile gln ile thr arg asp ile ala glu gln val ile thr asp thr thr
901/301                                          931/311
gag gcg gtg acg aag tcg gtg caa agc cag gcc acc gac cgg cgg gat gcc gcg att cgc
glu ala val thr lys ser val gln ser gln ala thr asp arg arg asp ala ala ile arg
961/321                                          991/331
gac gcc gtg ctg gtg ttg gcc gcc atc gcg acc gcg atc gtc gtc gtg ttg gtg gtg gcg
asp ala val leu val leu ala ala ile ala thr ala ile val val val leu val val ala
```

SEQ ID NOS:485-486

FIG. 21D

```
1021/341                                          1051/351
cgc acg ctg gtc ggg ccg atg cgg gta ctg          cgt gat ggg gcg ctc aag gtt gct cat acc
arg thr leu val gly pro met arg val leu          arg asp gly ala leu lys val ala his thr
1081/361                                          1111/371
gat ctc gac ggc gag atc gcg gcg gtc cgc          gcc ggc gac gag ccg atc ccc gag cca ctg
asp leu asp gly glu ile ala ala val arg          ala gly asp glu pro ile pro glu pro leu
1141/381                                          1171/391
gcg gtg tac acc acc gag gaa atc ggt cag          gtc gcg cat gcg gtc gac gag ctg cac acc
ala val tyr thr thr glu glu ile gly gln          val ala his ala val asp glu leu his thr
1201/401                                          1231/411
cgg gcc ctg ttg ctg gcc ggc gag gaa acg          cgg ttg cga ctg ctg gtc aac gag atg ttt
arg ala leu leu leu ala gly glu glu thr          arg leu arg leu leu val asn glu met phe
1261/421                                          1291/431
gag acc atg tcg cgg cgt agc cgt tcc ctg          gtc gac cag cag ctg tcg gtc atc gac caa
glu thr met ser arg arg ser arg ser leu          val asp gln gln leu ser val ile asp gln
1321/441                                          1351/451
ctg gag cgc aac gag gag gat ccc gcc cga          ctc gac agc ctt ttc cgg ctc gat cac ctg
leu glu arg asn glu glu asp pro ala arg          leu asp ser leu phe arg leu asp his leu
1381/461                                          1411/471
gcc gcc cgg ctg cgc cgc aac agc gcc aac          ctg ctg gtg ctg gcc ggt gcg cag att acc
ala ala arg leu arg arg asn ser ala asn          leu leu val leu ala gly ala gln ile thr
1441/481                                          1471/491
cgt gac cac cgc gag ccg gtg ccg ctg tca          acc gtg atc agc gcc gcc gtg tca gag gtc
arg asp his arg glu pro val pro leu ser          thr val ile ser ala ala val ser glu val
1501/501                                          1531/511
gag gac tat cgc cgc gtc gac atc gcg agg          gta ccc gac tgt gcg gta gtc ggc gca gcg
glu asp tyr arg arg val asp ile ala arg          val pro asp cys ala val val gly ala ala
1561/521                                          1591/531
gct ggt ggc gtc att cat ctg ctt gcc gag          ctg atc gac aac gcg ttg cgc tac tcg tca
ala gly gly val ile his leu leu ala glu          leu ile asp asn ala leu arg tyr ser ser
1621/541                                          1651/551
ccg acc aca ccc gtt cgg gtt gcc gcc gca          atc ggc agc gaa ggc agt gtt ctg ctg cga
pro thr thr pro val arg val ala ala ala          ile gly ser glu gly ser val leu leu arg
1681/561                                          1711/571
atc tcg gat tcc ggc ctg ggc atg acc gat          gcc gat cgg cgg atg gcc aat atg cgg ctg
ile ser asp ser gly leu gly met thr asp          ala asp arg arg met ala asn met arg leu
1741/581                                          1771/591
cgg gcc ggc ggt gag gtc acc ccg gat agt          gcc cgg cac atg ggt ctg ttc gta gtc ggc
arg ala gly gly glu val thr pro asp ser          ala arg his met gly leu phe val val gly
1801/601                                          1831/611
cgg ctg gcc ggt cgg cac ggc atc cga gtc          ggg ctg cgc ggt ccg gtg acc ggt gaa cag
arg leu ala gly arg his gly ile arg val          gly leu arg gly pro val thr gly glu gln
1861/621                                          1891/631
ggc acc ggc acc acc gcc gag gtc tac ctg          ccg cta gcc gtg ctc gag ggg acg gcc cca
gly thr gly thr thr ala glu val tyr leu          pro leu ala val leu glu gly thr ala pro
1921/641                                          1951/651
gcg cag ccg cca aag ccg cgg gta ttt gcg          atc aag ccg ccg tgt cct gaa ccc gcg gcg
ala gln pro pro lys pro arg val phe ala          ile lys pro pro cys pro glu pro ala ala
1981/661                                          2011/671
gcc gat ccg acg gac gtt ccc gcc gcc atc          ggg ccg cta cca ccg gtc acg ttg ctc ccg
ala asp pro thr asp val pro ala ala ile          gly pro leu pro pro val thr leu leu pro
```

SEQ ID NOS:485-486 (continued 1)

FIG. 21D (continued 1)

```
2041/681                                          2071/691
cgc cgt acc ccg ggg tcc agt ggc atc gcc gac gtc ccg gcc cag ccg atg cag cag cgg
arg arg thr pro gly ser ser gly ile ala asp val pro ala gln pro met gln gln arg
2101/701                                          2131/711
cgg cgc gag ctg aaa aca ccc tgg tgg gag gat agg ttt caa cag gag ccc aaa caa ccg
arg arg glu leu lys thr pro trp trp glu asp arg phe gln gln glu pro lys gln pro
2161/721                                          2191/731
ccc gca cca gaa ccg cga ccg gcg ccg ccg ccc gcc aaa ccc gcg cca ccg gcg ggc ccg
pro ala pro glu pro arg pro ala pro pro pro ala lys pro ala pro pro ala gly pro
2221/741                                          2251/751
gtt gat gac gac gtc atc tac cgg cgg atg ctc tcc gag atg gtg ggt gac ccg cac gag
val asp asp asp val ile tyr arg arg met leu ser glu met val gly asp pro his glu
2281/761                                          2311/771
ctg gcc cac agc ccc gat ctg gac tgg aag tcg gtg tgg gac cac ggc tgg tcg gcg gcc
leu ala his ser pro asp leu asp trp lys ser val trp asp his gly trp ser ala ala
2341/781                                          2371/791
gcc gag gcc gcg gac aag ccc gtg cag tcc cgc acg gac tac ggc ctg ccg gtg cgc gaa
ala glu ala ala asp lys pro val gln ser arg thr asp tyr gly leu pro val arg glu
2401/801                                          2431/811
ccc ggg gcc cgg tta gtg ccg ggg gcg gcg gtg cct gag gga ccc gat cgg gag cat ccg
pro gly ala arg leu val pro gly ala ala val pro glu gly pro asp arg glu his pro
2461/821                                          2491/831
ggt gca gcg cta gca tcc aac ggc gga ctt cat ccc ggc cga gcg ccg cgg cac gcg gct
gly ala ala leu ala ser asn gly gly leu his pro gly arg ala pro arg his ala ala
2521/841                                          2551/851
gcg gta cgc gac ccc gac gcg gtt cgt gcc tcc atc agc agc cat ttc ggc ggc gtg cgc
ala val arg asp pro asp ala val arg ala ser ile ser ser his phe gly gly val arg
2581/861                                          2611/871
acc ggg cgg tcg cat gcc cgc gag agc agt cag gga ccc aat cag caa tga
thr gly arg ser his ala arg glu ser ser gln gly pro asn gln gln)OPA
```

SEQ ID NOS:485-486 (continued)

FIG. 21D (continued)

ORF according to Cole et al. (Nature 393:537-544) and containing Rv3365c

```
1/1     SEQ ID NO: 487                    31/11
taa ggg tgc ggc cgg tgg cac ggc cgc ggc cac gtg acc atg ttc gcc cgc ccg acc atc
OCH gly cys gly arg trp his gly arg gly his val thr met phe ala arg pro thr ile
61/21   SEQ ID NO: 488                    91/31
ccg gtc gcg gcg gcc gct tct gat att tcc gcc ccg gct caa ccg gcc cgc ggc aaa cct
pro val ala ala ala ala ser asp ile ser ala pro ala gln pro ala arg gly lys pro
121/41                                    151/51
cag caa cgc ccg ccg tcc tgg tcg ccg cgc aac tgg ccg gtc cga tgg aaa gtg ttc acg
gln gln arg pro pro ser trp ser pro arg asn trp pro val arg trp lys val phe thr
181/61                                    211/71
atc gcg ctt ctg ccg ctg gta gtg gcg atg gtg tta gca gga ttg cgg gtc gag gct gcg
ile ala leu leu pro leu val val ala met val leu ala gly leu arg val glu ala ala
241/81                                    271/91
atg gcc agc acc agc ggc ctg cgg ctg gtc gcc gcg cgc gcc gaa atg ata ccc gcg atc
met ala ser thr ser gly leu arg leu val ala ala arg ala glu met ile pro ala ile
301/101                                   331/111
acg aaa tac atg tcg gcg ctg gac gtc gcc gtg ctg gcc agc tcg acc gga cac gat gtg
thr lys tyr met ser ala leu asp val ala val leu ala ser ser thr gly his asp val
361/121                                   391/131
gag ggg gcg cag aaa aac ttc acc gcc cgc aag tac gag ctg cag acg cga ctg gcc gac
glu gly ala gln lys asn phe thr ala arg lys tyr glu leu gln thr arg leu ala asp
421/141                                   451/151
acc gac gtc atc gca gac gtg cgg tcg gga gtg aac acg ctc aac ggc ggt cag gcg
thr asp val ile ala asp val arg ser gly val asn thr leu leu asn gly gly gln ala
481/161                                   511/171
ctg ctg gat aag gtg ctg gcc gac agc atc ggc ttg cgg gat cgg gtc acc gcc tac gcg
leu leu asp lys val leu ala asp ser ile gly leu arg asp arg val thr ala tyr ala
541/181                                   571/191
ccg ctg ctg ttg acg gcc cag aac gtg att gac gcg tcg gtg cgg gtt gac agc gag caa
pro leu leu leu thr ala gln asn val ile asp ala ser val arg val asp ser glu gln
601/201                                   631/211
atc cga acc cag gtg cag ggt ttg agc cga gcc gtt ggc gcc cgc ggg cag atg acg atg
ile arg thr gln val gln gly leu ser arg ala val gly ala arg gly gln met thr met
661/221                                   691/231
cag gag atc ctg gtg act cgc ggc gcc gac ctt gcc gag ccg caa ctg cgc agc gcg atg
gln glu ile leu val thr arg gly ala asp leu ala glu pro gln leu arg ser ala met
721/241                                   751/251
gtt acc ctg gcc ggc acc gaa ccc tcg acg ctg ttc ggg atg agc gcg gcg ctc ggt gca
val thr leu ala gly thr glu pro ser thr leu phe gly met ser ala ala leu gly ala
781/261                                   811/271
ggc tcg ccg gac acc aag aac ctg cag cag caa atg gtg acc agg atg gcg atc atg tcc
gly ser pro asp thr lys asn leu gln gln gln met val thr arg met ala ile met ser
841/281                                   871/291
gat ccg gcc gtt gca ctg gtc aac aac cca gag ctg ctg cac tcg ata cag atc acc cgc
asp pro ala val ala leu val asn asn pro glu leu leu his ser ile gln ile thr arg
```

SEQ ID NOS:487-488

FIG. 21E

```
901/301                              931/311
gac att gcc gag cag gtg atc acc gac acc acc gag gcg gtg acg aag tcg gtg caa agc
asp ile ala glu gln val ile thr asp thr thr glu ala val thr lys ser val gln ser
961/321                              991/331
cag gcc acc gac cgg cgg gat gcc gcg att cgc gac gcc gtg ctg gtg ttg gcc gcc atc
gln ala thr asp arg arg asp ala ala ile arg asp ala val leu val leu ala ala ile
1021/341                             1051/351
gcg acc gcg atc gtc gtc gtg ttg gtg gtg gcg cgc acg ctg gtc ggg ccg atg cgg gta
ala thr ala ile val val val leu val val ala arg thr leu val gly pro met arg val
1081/361                             1111/371
ctg cgt gat ggg gcg ctc aag gtt gct cat acc gat ctc gac ggc gag atc gcg gcg gtc
leu arg asp gly ala leu lys val ala his thr asp leu asp gly glu ile ala ala val
1141/381                             1171/391
cgc gcc ggc gac gag ccg atc ccc gag cca ctg gcg gtg tac acc acc gag gaa atc ggt
arg ala gly asp glu pro ile pro glu pro leu ala val tyr thr thr glu glu ile gly
1201/401                             1231/411
cag gtc gcg cat gcg gtc gac gag ctg cac acc cgg gcc ctg ttg ctg gcc ggc gag gaa
gln val ala his ala val asp glu leu his thr arg ala leu leu leu ala gly glu glu
1261/421                             1291/431
acg cgg ttg cga ctg ctg gtc aac gag atg ttt gag acc atg tcg cgg cgt agc cgt tcc
thr arg leu arg leu leu val asn glu met phe glu thr met ser arg arg ser arg ser
1321/441                             1351/451
ctg gtc gac cag cag ctg tcg gtc atc gac caa ctg gag cgc aac gag gag gat ccc gcc
leu val asp gln gln leu ser val ile asp gln leu glu arg asn glu glu asp pro ala
1381/461                             1411/471
cga ctc gac agc ctt ttc cgg ctc gat cac ctg gcc gcc cgg ctg cgc cgc aac agc gcc
arg leu asp ser leu phe arg leu asp his leu ala ala arg leu arg arg asn ser ala
1441/481                             1471/491
aac ctg ctg gtg ctg gcc ggt gcg cag att acc cgt gac cac cgc gag ccg gtg ccg ctg
asn leu leu val leu ala gly ala gln ile thr arg asp his arg glu pro val pro leu
1501/501                             1531/511
tca acc gtg atc agc gcc gcc gtg tca gag gtc gag gac tat cgc cgc gtc gac atc gcg
ser thr val ile ser ala ala val ser glu val glu asp tyr arg arg val asp ile ala
1561/521                             1591/531
agg gta ccc gac tgt gcg gta gtc ggc gca gcg gct ggt ggc gtc att cat ctg ctt gcc
arg val pro asp cys ala val val gly ala ala ala gly gly val ile his leu leu ala
1621/541                             1651/551
gag ctg atc gac aac gcg ttg cgc tac tcg tca ccg acc aca ccc gtt cgg gtt gcc gcc
glu leu ile asp asn ala leu arg tyr ser ser pro thr thr pro val arg val ala ala
1681/561                             1711/571
gca atc ggc agc gaa ggc agt gtt ctg ctg cga atc tcg gat tcc ggc ctg ggc atg acc
ala ile gly ser glu gly ser val leu leu arg ile ser asp ser gly leu gly met thr
1741/581                             1771/591
gat gcc gat cgg cgg atg gcc aat atg cgg ctg cgg gcc ggc ggt gag gtc acc ccg gat
asp ala asp arg arg met ala asn met arg leu arg ala gly gly glu val thr pro asp
1801/601                             1831/611
agt gcc cgg cac atg ggt ctg ttc gta gtc ggc cgg ctg gcc ggt cgg cac ggc atc cga
ser ala arg his met gly leu phe val val gly arg leu ala gly arg his gly ile arg
```

SEQ ID NOS:487-488 (continued 1)

```
1861/621                                    1891/631
gtc ggg ctg cgc ggt ccg gtg acc ggt gaa    cag ggc acc ggc acc acc gcc gag gtc tac
val gly leu arg gly pro val thr gly glu    gln gly thr gly thr thr ala glu val tyr
1921/641                                    1951/651
ctg ccg cta gcc gtg ctc gag ggg acg gcc    cca gcg cag ccg cca aag ccg cgg gta ttt
leu pro leu ala val leu glu gly thr ala    pro ala gln pro pro lys pro arg val phe
1981/661                                    2011/671
gcg atc aag ccg ccg tgt cct gaa ccc gcg    gcg gcc gat ccg acg gac gtt ccc gcc gcc
ala ile lys pro pro cys pro glu pro ala    ala ala asp pro thr asp val pro ala ala
2041/681                                    2071/691
atc ggg ccg cta cca ccg gtc acg ttg ctc    ccg cgc cgt acc ccg ggg tcc agt ggc atc
ile gly pro leu pro pro val thr leu leu    pro arg arg thr pro gly ser ser gly ile
2101/701                                    2131/711
gcc gac gtc ccg gcc cag ccg atg cag cag    cgg cgg cgc gag ctg aaa aca ccc tgg tgg
ala asp val pro ala gln pro met gln gln    arg arg arg glu leu lys thr pro trp trp
2161/721                                    2191/731
gag gat agg ttt caa cag gag ccc aaa caa    ccg ccc gca cca gaa ccg cga ccg gcg ccg
glu asp arg phe gln gln glu pro lys gln    pro pro ala pro glu pro arg pro ala pro
2221/741                                    2251/751
ccg ccc gcc aaa ccc gcg cca ccg gcg ggc    ccg gtt gat gac gac gtc atc tac cgg cgg
pro pro ala lys pro ala pro pro ala gly    pro val asp asp asp val ile tyr arg arg
2281/761                                    2311/771
atg ctc tcc gag atg gtg ggt gac ccg cac    gag ctg gcc cac agc ccc gat ctg gac tgg
met leu ser glu met val gly asp pro his    glu leu ala his ser pro asp leu asp trp
2341/781                                    2371/791
aag tcg gtg tgg gac cac ggc tgg tcg gcg    gcc gcc gag gcc gcg gac aag ccc gtg cag
lys ser val trp asp his gly trp ser ala    ala ala glu ala ala asp lys pro val gln
2401/801                                    2431/811
tcc cgc acg gac tac ggc ctg ccg gtg cgc    gaa ccc ggg gcc cgg tta gtg ccg ggg gcg
ser arg thr asp tyr gly leu pro val arg    glu pro gly ala arg leu val pro gly ala
2461/821                                    2491/831
gcg gtg cct gag gga ccc gat cgg gag cat    ccg ggt gca gcg cta gca tcc aac ggc gga
ala val pro glu gly pro asp arg glu his    pro gly ala ala leu ala ser asn gly gly
2521/841                                    2551/851
ctt cat ccc ggc cga gcg ccg cgg cac gcg    gct gcg gta cgc gac ccc gac gcg gtt cgt
leu his pro gly arg ala pro arg his ala    ala ala val arg asp pro asp ala val arg
2581/861                                    2611/871
gcc tcc atc agc agc cat ttc ggc ggc gtg    cgc acc ggg cgg tcg cat gcc cgc gag agc
ala ser ile ser ser his phe gly gly val    arg thr gly arg ser his ala arg glu ser
2641/881
agt cag gga ccc aat cag caa tga
ser gln gly pro asn gln gln)OPA
```

SEQ ID NOS:487-488 (continued 2)

FIG. 21E (continued 2)

```
         SEQ ID NO: 489                          31/11
CTA CGA CAA GGC AAA GGA GCA CAG GGT GAA GCG TGG ACT GAC GGT CGC GGT AGC CGG AGC
(leu arg gln gly lys gly ala gln gly glu ala trp thr asp gly arg gly ser arg ser
 61/21         SEQ ID NO: 490                    91/31
CGC CAT TCT GGT CGC AGG TCT TTC CGG ATG TTC AAG CAA CAA GTC GAC TAC AGG AAG CGG
 arg his ser gly arg arg ser phe arg met phe lys gln gln val asp tyr arg lys arg)
121/41                                          151/51
TGA CAC GAC CGC GGC AGG CAC GAC GGC AAG CCC CGG CGC CGC ATC CGG GCC GAA GGT
OPA(asp his asp arg gly arg his asp gly lys pro arg arg arg ile arg ala glu gly
181/61         SEQ ID NO: 491                   211/71
CGT CAT CGA CGG TAA GGA CCA GAA CGT CAC CGG GTC TGT GGT GTG CAC AAC CGC GGC CGG
 arg his arg arg)OCH(gly pro glu arg his arg val cys gly val his asn arg gly arg
241/81                 SEQ ID NO: 492           271/91
CAA TGT CAA CAT CGC GAT CGG CGG GGC GGC GAC CGG CAT TGC CGC CGT GCT CAC CGA CGG
 gln cys gln his arg asp arg arg gly gly asp arg his cys arg arg ala his arg arg
301/101                                         331/111
CAA CCC TCC GGA GGT GAA GTC CGT TGG GCT CGG TAA CGT CAA CGG CGT CAC GCT GGG ATA
 gln pro ser gly gly glu val arg trp ala arg)OCH(arg gln arg arg his ala gly ile
361/121                                391/131  SEQ ID NO: 493
CAC GTC GGG CAC CGG ACA GGG TAA CGC TCG GCA ACC AAG GAC GGC AGC CAC TAC AAG ATC
 his val gly his arg thr gly)OCH(arg ser ala thr lys asp gly ser his tyr lys ile)
                                          SEQ ID NO: 494

SEQ ID NOS:489-494

FIG. 22A

SEQ ID NO: 495                          32/11
TAC GAC AAG GCA AAG GAG CAC AGG GTG AAG CGT GGA CTG ACG GTC GCG GTA GCC GGA GCC
(tyr asp lys ala lys glu his arg val lys arg gly leu thr val ala val ala gly ala
 62/21        SEQ ID NO: 496                     92/31
GCC ATT CTG GTC GCA GGT CTT TCC GGA TGT TCA AGC AAC AAG TCG ACT ACA GGA AGC GGT
 ala ile leu val ala gly leu ser gly cys ser ser asn lys ser thr thr gly ser gly
122/41                                          152/51
GAG ACC ACG ACC GCG GCA GGC ACG ACG GCA AGC CCC GGC GCC GCA TCC GGG CCG AAG GTC
 glu thr thr thr ala ala gly thr thr ala ser pro gly ala ala ser gly pro lys val
182/61                                          212/71
GTC ATC GAC GGT AAG GAC CAG AAC GTC ACC GGG TCT GTG GTG TGC ACA ACG CGG CCG GC
 val ile asp gly lys asp gln asn val thr gly ser val val cys thr thr ala ala gly
242/81                                          272/91
AAT GTC AAC ATC GCG ATC GGC GGG GCG GCG ACC GGC ATT GCC GCC GTG CTC ACC GAC GGC
 asn val asn ile ala ile gly gly ala ala thr gly ile ala ala val leu thr asp gly
302/101                                         332/111
AAC CCT CCG GAG GTG AAG TCC GTT GGG CTC GGT AAC GTC AAC GGC GTC ACG CTG GGA TAC
 asn pro pro glu val lys ser val gly leu gly asn val asn gly val thr leu gly tyr
362/121                                         392/131
ACG TCG GGC ACC GGA CAG GGT AAC GCT CGG CAA CCA AGG ACG GCA GCC ACT ACA AGA TC
 thr ser gly thr gly gln gly asn ala arg gln pro arg thr ala ala thr thr arg)

SEQ ID NOS:495-496

FIG. 22B
```

SEQ ID NO: 497
```
                                              33/11
ACG ACA AGG CAA AGG AGC ACA GGG TGA AGC GTG GAC TGA CGG TCG CGG TAG CCG GAG CCG
(thr thr arg gln arg ser thr gly)OPA ser val asp OPA arg ser arg AMB(pro glu pro
63/21   SEQ ID NO: 498                        93/31    SEQ ID NO: 499
CCA TTC TGG TCG CAG GTC TTT CCG GAT GTT CAA GCA ACA AGT CGA CTA CAG GAA GCG GTG
pro phe trp ser gln val phe pro asp val gln ala thr ser arg leu gln glu ala val
123/41                                         153/51
AGA CCA CGA CCG CGG CAG GCA CGA CGG CAA GCC CCG GCG CCG CAT CCG GGC CGA AGG TCG
arg pro arg pro arg gln ala arg arg gln ala pro ala pro his pro gly arg arg ser
183/61                                         213/71
TCA TCG ACG GTA AGG ACC AGA ACG TCA CCG GGT CTG TGG TGT GCA CAA CCG CGG CCG GCA
ser ser thr val arg thr arg thr ser pro gly leu trp cys ala gln pro arg pro ala
243/81                                         273/91
ATG TCA ACA TCG CGA TCG GCG GGG CGG CGA CCG GCA TTG CCG CCG TGC TCA CCG ACG GCA
met ser thr ser arg ser ala gly arg arg pro ala leu pro pro cys ser pro thr ala
303/101                                        333/111
ACC CTC CGG AGG TGA AGT CCG TTG GGC TCG GTA ACG TCA ACG GCG TCA CGC TGG GAT ACA
thr leu arg arg)OPA(ser pro leu gly ser val thr ser thr ala ser arg trp asp thr
363/121          SEQ ID NO: 500     393/131
CGT CGG GCA CCG GAC AGG GTA ACG CTC GGC AAC CAA GGA CGG CAG CCA CTA CAA GAT C
arg arg ala pro asp arg val thr leu gly asn gln gly arg gln pro leu gln asp)
```
SEQ ID NOS:497-500

FIG. 22C

SEQ ID NO: 501
```
                                              31/11
GCA CAA CCG CGG CCG GCA ATG TCA ACA TCG CGA TCG GCG GGG CGG CGA CCG GCA TTG CCG
(ala gln pro arg pro ala met ser thr ser arg ser ala gly arg arg pro ala leu pro
61/21   SEQ ID NO: 502                        91/31
CCG TGC TCA CCG ACG GCA ACC CTC CGG AGG TGA AGT CCG TTG GGC TCG GTA ACG TCA ACG
pro cys ser pro thr ala thr leu arg arg)OPA(ser pro leu gly ser val thr ser thr
121/41                                         151/51   SEQ ID NO: 503
GCG TCA CGC TGG GAT ACA CGT CGG GCA CCG GAC AGG GTA ACG CCT CGG CAA CCA AGG ACG
ala ser arg trp asp thr arg arg ala pro asp arg val thr pro arg gln pro arg thr
181/61                                         211/71
GCA GCC ACT ACA AGA TCA CAG GGT GAA GCG TGG ACT GAC GGT CGC GGT AGC GGA GCC GC
ala ala thr thr arg ser gln gly glu ala trp thr asp gly arg gly ser arg ser arg
241/81                                         271/91
CAT TCT GGT CGC AGG TCT TTC GGA TGT TCA AGC AAC AAG TCG ACT ACA GGA AGC GGT GAA
his ser gly arg arg ser phe arg met phe lys gln gln val asp tyr arg lys arg)OPA
301/101                                        331/111
GAC CAC GAC CGC GGC AGG CAC GAC GGC AAG CCC CGG CGC GCT CGG GCC GAA GGT CGT C
(asp his asp arg gly arg his asp gly lys pro arg arg arg ser gly pro lys val val
361/121   SEQ ID NO: 504            391/131
ATC GAC GGT AAG GAC CAG AAC GTC ACC GGC TCC GTG GTG TGC ACA ACC GCG GCC GGC AAT
ile asp gly lys asp gln asn val thr gly ser val val cys thr thr ala ala gly asn
421/141                                        451/151
GTC AAC ATC GCG ATC GGC GGG GCG GCG ACC GGC ATT GCC GCC GTG CTC ACC GAC GGC AAC
val asn ile ala ile gly gly ala ala thr gly ile ala ala val leu thr asp gly asn
481/161                                        511/171
CCT CCG GAG GTG AAG TCC GTT GGG CTC GGT AAC GTC AAC GGC GTC ACG CTG GGA TAC ACG
pro pro glu val lys ser val gly leu gly asn val asn gly val thr leu gly tyr thr
541/181                                        571/191
TCG GGC ACC GGA CAG GGT AAC GCC TCG GCA ACC AAG GAC GGC AGC CAC TAC AAG ATC
ser gly thr gly gln gly asn ala ser ala thr lys asp gly ser his tyr lys ile)
```
SEQ ID NOS:501-504

FIG. 23A

```
                    SEQ ID NO: 505                          32/11
CAC AAC CGC GGC CGG CAA TGT CAA CAT CGC GAT CGG CGG GGC GGC GAC CGG CAT TGC CGC
(his asn arg gly arg gln cys gln his arg asp arg arg gly gly asp arg his cys arg
 62/21      SEQ ID NO: 506                                92/31
CGT GCT CAC CGA CGG CAA CCC TCC GGA GGT GAA GTC CGT TGG GCT CGG TAA CGT CAA CGG
arg ala his arg arg gln pro ser gly gly glu val arg trp ala arg)OCH(arg gln arg
122/41                                        152/51    SEQ ID NO: 507
CGT CAC GCT GGG ATA CAC GTC GGG CAC CGG ACA GGG TAA CGC CTC GGC AAC CAA GGA CGG
arg his ala gly ile his val gly his arg thr gly)OCH(arg leu gly asn gln gly arg
182/61                                        212/71        SEQ ID NO: 508
CAG CCA CTA CAA GAT CAC AGG GTG AAG CGT GGA CTG ACG GTC GCG GTA GCC GGA GCC GCC
gln pro leu gln asp his arg val lys arg gly leu thr val ala val ala gly ala ala
242/81                                        272/91
ATT CTG GTC GCA GGT CTT TCC GGA TGT TCA AGC AAC AAG TCG ACT ACA GGA AGC GGT GAG
ile leu val ala gly leu ser gly cys ser ser asn lys ser thr thr gly ser gly glu
302/101                                       332/111
ACC ACG ACC GCG GCA GGC ACG ACG GCA AGC CCC GGC GCC GCT CCG GGC CGA AGG TCG TCA
thr thr thr ala ala gly thr thr ala ser pro gly ala ala pro gly arg arg ser ser
362/121                                       392/131
TCG ACG GTA AGG ACC AGA ACG TCA CCG GCT CCG TGG TGT GCA CAA CCG CGG CCG GCA ATG
ser thr val arg thr arg thr ser pro ala pro trp cys ala gln pro arg pro ala met
422/141                                       452/151
TCA ACA TCG CGA TCG GCG GGG CGG CGA CCG GCA TTG CCG CCG TGC TCA CCG ACG GCA ACC
ser thr ser arg ser ala gly arg arg pro ala leu pro pro cys ser pro thr ala thr
482/161                                       512/171
CTC CGG AGG TGA AGT CCG TTG GGC TCG GTA ACG TCA ACG GCG TCA CGC TGG GAT ACA CGT
leu arg arg)OPA(ser pro leu gly ser val thr ser thr ala ser arg trp asp thr arg
542/181              SEQ ID NO: 509           572/191
CGG GCA CCG GAC AGG GTA ACG CCT CGG CAA CCA AGG ACG GCA GCC ACT ACA AGA TC
arg ala pro asp arg val thr pro arg gln pro arg thr ala ala thr thr arg)
```

SEQ ID NOS:505-509

FIG. 23B

```
         ┌─── SEQ ID NO: 510                          33/11
ACA ACC GCG GCC GGC AAT GTC AAC ATC GCG ATC GGC GGG GCG GCG ACC GGC ATT GCC GCC
(thr thr ala ala gly asn val asn ile ala ile gly gly ala ala thr gly ile ala ala
63/21 ─── SEQ ID NO: 511                              93/31
GTG CTC ACC GAC GGC AAC CCT CCG GAG GTG AAG TCC GTT GGG CTC GGT AAC GTC AAC GGC
val leu thr asp gly asn pro pro glu val lys ser val gly leu gly asn val asn gly
123/41                                                153/51
GTC ACG CTG GGA TAC ACG TCG GGC ACC GGA CAG GGT AAC GCC TCG GCA ACC AAG GAC GGC
val thr leu gly tyr thr ser gly thr gly gln gly asn ala ser ala thr lys asp gly
183/61                                                213/71
AGC CAC TAC AAG ATC ACA GGG TGA AGC GTG GAC TGA CGG TCG CGG TAG CCG CAG CCG CCA
ser his tyr lys ile thr gly)OPA ser val asp OPA arg ser arg AMB(pro glu pro pro
243/81                                                273/91    SEQ ID NO: 512
TTC TGG TCG CAG GTC TTT CCG GAT GTT CAA GCA ACA AGT CGA CTA CAG GAA GCG GTG AGA
phe trp ser gln val phe pro asp val gln ala thr ser arg leu gln glu ala val arg
303/101                                               333/111
CCA CGA CCG CGG CAG GCA CGA CGG CAA GCC CCG GCG CCG CTC CGG GCC GAA GGT CGT CAT
pro arg pro arg gln ala arg arg gln ala pro ala pro leu arg ala glu gly arg his
363/121                                               393/131
CGA CGG TAA GGA CCA GAA CGT CAC CGG CTC CGT GGT GTG CAC AAC CGC GGC CGG CAA TGT
arg arg)OCH(gly pro glu arg his arg leu arg gly val his asn arg gly arg gln cys
423/141        ─── SEQ ID NO: 513                     453/151
CAA CAT CGC GAT CGG CGG GGC GGC GAC CGG CAT TGC CGC CGT GCT CAC CGA CGG CAA CCC
gln his arg asp arg arg gly gly asp arg his cys arg arg ala his arg arg gln pro
483/161                                               513/171
TCC GGA GGT GAA GTC CGT TGG GCT CGG TAA CGT CAA CGG CGT CAC GCT GGG ATA CAC GTC
ser gly gly glu val arg trp ala arg)OCH(arg gln arg arg his ala gly ile his val
543/181               SEQ ID NO: 514 ───              573/191
GGG CAC CGG ACA GGG TAA CGC CTC GGC AAC CAA GGA CGG CAG CCA CTA CAA GAT C
gly his arg thr gly)OCH(arg leu gly asn gln gly arg gln pro leu gln asp)
                      ─── SEQ ID NO: 515
```

SEQ ID NOS:510-515

FIG. 23C

SEQ ID NO: 516  31/11
CTA ACG ACA GGC AAA GGA GCA CAG GGT GAA GCG TGG ACT GAC GGT CGC GGT AGC CGG AGC
(leu thr thr gly lys gly ala gln gly glu ala trp thr asp gly arg gly ser arg ser
61/21  SEQ ID NO: 517  91/31
CGC CAT TCT GGT CGC AGG TCT TTC CGG ATG TTC AAG CAA CAA GTC GAC TAC AGG AAG CGG
arg his ser gly arg arg ser phe arg met phe lys gln gln val asp tyr arg lys arg)
121/41  151/51
TGA GAC CAC GAC CGC GGC AGG CAC GAC GGC AAG CCC CGG CGC CGC TCC GGG CCG AAG GTC
OPA(asp his asp arg gly arg his asp gly lys pro arg arg arg ser gly pro lys val
181/61  SEQ ID NO: 518  211/71
GTC ATC GAC GGT AAG GAC CAG AAC GTC ACC GGC TCC GTG GTG TGC ACA ACC GCG GCC GGC
val ile asp gly lys asp gln asn val thr gly ser val val cys thr thr ala ala gly
241/81  271/91
AAT GTC AAC ATC GCG ATC GGC GGG GCG GCG ACC GGC ATT GCC GCC GTG CTC ACC GAC GGC
asn val asn ile ala ile gly gly ala ala thr gly ile ala ala val leu thr asp gly
301/101  331/111
AAC CCT CCG GAG GTG AAG TCC GTT GGG CTC GGT AAC GTC AAC GGC GTC ACG CTG GGA TAC
asn pro pro glu val lys ser val gly leu gly asn val asn gly val thr leu gly tyr
361/121  391/131
ACG TCG GGC ACC GGA CAG GGT AAC GCC TCG GCA ACC AAG GAC GGC AGC CAC TAC AAG ATC
thr ser gly thr gly gln gly asn ala ser ala thr lys asp gly ser his tyr lys ile)

SEQ ID NOS:516-518

FIG. 24A

SEQ ID NO: 519  32/11
TAA CGA CAG GCA AAG GAG CAC AGG GTG AAG CGT GGA CTG ACG GTC GCG GTA GCC GGA GCC
OCH(arg gln ala lys glu his arg val lys arg gly leu thr val ala val ala gly ala
62/21  SEQ ID NO: 520  92/31
GCC ATT CTG GTC GCA GGT CTT TCC GGA TGT TCA AGC AAC AAG TCG ACT ACA GGA AGC GGT
ala ile leu val ala gly leu ser gly cys ser ser asn lys ser thr thr gly ser gly
122/41  152/51
GAG ACC ACG ACC GCG GCA GGC ACG ACG GCA AGC CCC GGC GCC GCT CCG GGC CGA AGG TCG
glu thr thr thr ala ala gly thr thr ala ser pro gly ala ala pro gly arg arg ser
182/61  212/71
TCA TCG ACG GTA AGG ACC AGA ACG TCA CCG GCT CCG TGG TGT GCA CAA CCG CGG CCG GCA
ser ser thr val arg thr arg thr ser pro ala pro trp cys ala gln pro arg pro ala
242/81  272/91
ATG TCA ACA TCG CGA TCG GCG GGG CGG CGA CCG GCA TTG CCG CCG TGC TCA CCG ACG GCA
met ser thr ser arg ser ala gly arg arg pro ala leu pro pro cys ser pro thr ala
302/101  332/111
ACC CTC CGG AGG TGA AGT CCG TTG GCT CGT ACG TCA ACG GCG TCA CGC TGG GAT ACA
thr leu arg arg)OPA(ser pro leu gly ser val thr ser thr ala ser arg trp asp thr
362/121  SEQ ID NO: 521  392/131
CGT CGG GCA CCG GAC AGG GTA ACG CCT CGG CAA CCA AGG ACG GCA GCC ACT ACA AGA TC
arg arg ala pro asp arg val thr pro arg gln pro arg thr ala ala thr thr arg)

SEQ ID NOS:519-521

FIG. 24B

```
            SEQ ID NO: 522                      33/11
AAC GAC AGG CAA AGG AGC ACA GGG TGA AGC GTG GAC TGA CGG TCG CGG TAG CCG GAG CCG
(asn asp arg gln arg ser thr gly)OPA ser val asp OPA arg ser arg AMB(pro glu pro
 63/21    SEQ ID NO: 523                       93/31      SEQ ID NO: 524
CCA TTC TGG TCG CAG GTC TTT CCG GAT GTT CAA GCA ACA AGT CGA CTA CAG GAA GCG GTG
pro phe trp ser gln val phe pro asp val gln ala thr ser arg leu gln glu ala val
123/41                                        153/51
AGA CCA CGA CCG CGG CAG GCA CGA CGG CAA GCC CCG GCG CCG CTC CGG GCC GAA GGT CGT
arg pro arg pro arg gln ala arg arg gln ala pro ala pro leu arg ala glu gly arg
183/61                                        213/71
CAT CGA CGG TAA GGA CCA GAA CGT CAC CGG CTC CGT GGT GTG CAC AAC CGC GGC CGG CAA
his arg arg)OCH(gly pro glu arg his arg leu arg gly val his asn arg gly arg gln
243/81             SEQ ID NO: 525             273/91
TGT CAA CAT CGC GAT CGG CGG GGC GGC GAC CGG CAT TGC CGC CGT GCT CAC CGA CGG CAA
cys gln his arg asp arg arg gly gly asp arg his cys arg arg ala his arg arg gln
303/101                                       333/111
CCC TCC GGA GGT GAA GTC CGT TGG GCT CGG TAA CGT CAA CGG CGT CAC GCT GGG ATA CAC
pro ser gly gly glu val arg trp ala arg)OCH(arg gln arg arg his ala gly ile his
363/121                                       393/131    SEQ ID NO: 526
GTC GGG CAC CGG ACA GGG TAA CGC CTC GGC AAC CAA GGA CGG CAG CCA CTA CAA GAT C
val gly his arg thr gly)OCH(arg leu gly asn gln gly arg gln pro leu gln asp)
                         SEQ ID NO: 527
```

SEQ ID NOS:522-527

FIG. 24C

Direct primer

SEQ ID NO: 528    5' ACG CGG CGC AGC CTG TTG 3'

SEQ ID No.528

FIG. 25

Reverse primer

SEQ ID NO: 529    5' CGA CCT TGG GAT TCG CCT 3'

SEQ ID No.529

FIG. 26

SEQ ID NO: 530                                                31/11
CCT ACC AGC AAG AGC CCA GGG CTT CAC AGG ACC TAA AAG GAG TAG CGC CCA TGG GCT TGA
(pro thr ser lys ser pro gly leu his arg thr)OCH lys glu AMB(arg pro trp ala)OPA
61/21     SEQ ID NO: 531                      91/31                SEQ ID NO: 532
TCC AAT TTT CCT TCC GCC CCG TGC AAT ACC ATC TGC AAG ACC AGC GAC GGC CCG TGG TTG
(ser asn phe pro ser ala pro cys asn thr ile cys lys thr ser asp gly pro trp leu
121/41    SEQ ID NO: 533                      151/51
CGG TCG CGC AGC TTG CGG AAA CGG GGT ATG GAC CCT GCC GTA CCG TTG TTG CCA CTT GAT
arg ser arg ser leu arg lys arg gly met asp pro ala val pro leu leu pro leu asp
181/61                                         211/71
GTC GTC GCT CTC CAC CCG TCG GGG GGC GAA AGC CAT TCC GAC ACT GGG ATC CTC AAA ACG
val val ala leu his pro ser gly gly glu ser his ser asp thr gly ile leu lys thr
241/81                                         271/91
TCG GCT GAG TGT CTG CAG GGC TCC GGG GAG CAG CCG ATC ATC ACC ATG TAC GAA CTG AAT
ser ala glu cys leu gln gly ser gly glu gln pro ile ile thr met tyr glu leu asn
301/101                                        331/111
AAG TCC CCC CCG CGC GAC TTC CAG ACA TTT GTT GTG GTT TCG GTT GAG GCC GAG GCG AGG
lys ser pro pro arg asp phe gln thr phe val val val ser val glu ala glu ala arg
361/121                                        391/131
CTC ATT TCG CAG CAA GCG GTC TCC GGG TCG CAG CAT CGT TGC GGC GAT CGC GGC GCA GTC
leu ile ser gln gln ala val ser gly ser gln his arg cys gly asp arg gly ala val
421/141
GTC GGA CGA GTC GTC GTC AAC GAC CAC GAT C
val gly arg val val val asn asp his asp)

SEQ ID NOS:530-533

FIG. 27A

SEQ ID NO: 534                                                 31/11
CTA CCA GCA AGA GCC CAG GGC TTC ACA GGA CCT AAA AGG AGT AGC GCC CAT GGG CTT GAT
(leu pro ala arg ala gln gly phe thr gly pro lys arg ser ser ala his gly leu asp
61/21     SEQ ID NO: 535                      91/31
CCA ATT TTC CTT CCG CCC CGT GCA ATA CCA TCT GCA AGA CCA GCG ACG GCC CGT GGT TGC
pro ile phe leu pro pro arg ala ile pro ser ala arg pro ala thr ala arg gly cys
121/41                                         151/51
GGT CGC GCA GCT TGC GGA AAC GGG GTA TGG ACC CTG CCG TAC GGT TGT TGC CAC TTG ATG
gly arg ala ala cys gly asn gly val trp thr leu pro tyr arg cys cys his leu met
181/61                                         211/71
TCG TCG CTC TCC ACC CGT CGG GGG GCG AAA GCC ATT CCG ACA CTG GGA TCC TCA AAA CGT
ser ser leu ser thr arg arg gly ala lys ala ile pro thr leu gly ser ser lys arg
241/81                                         271/91
CGG CTG AGT GTC TGC AGG GCT CCG GGA GCA GCC GAT CAT CAC CAT GTA CGA ACT GAA TAA
arg leu ser val cys arg ala pro gly ser ser arg ser ser pro cys thr asn)OPA(ile
301/101                                        331/111    SEQ ID NO: 536
AGT CCC CCC GCG CGA CTT CCA GAC ATT TGT TGT GGT TTC GGT TGA GGC CGA GGC GAG GC
ser pro pro arg ala thr ser arg his leu leu trp phe arg leu arg pro arg arg gly
361/121                                        391/131
TCA TTT CGC AGC AAG CGG TCT CCG GGT CGC AGC ATC GTT GCG CGA TCG CGG CGC AGT CG
ser phe arg ser lys arg ser pro gly arg ser ile val ala ala ile ala ala gln ser
421/141
TCG GAC GAG TCG TCG TCA ACG ACC ACG ATC
ser asp glu ser ser ser thr thr thr ile)

SEQ ID NOS:534-536

FIG. 27B

SEQ ID NO: 537                              33/11
TAC CAG CAA GAG CCC AGG GCT TCA CAG GAC CTA AAA GGA GTA GCG CCC ATG GGC TTG ATC
(tyr gln gln glu pro arg ala ser gln asp leu lys gly val ala pro met gly leu ile
63/21      SEQ ID NO: 538                  93/31
CAA TTT TCC TTC CGC CCC GTG CAA TAC CAT CTG CAA GAC CAG CGA CGG CCC GTG GTT GCG
gln phe ser phe arg pro val gln tyr his leu gln asp gln arg arg pro val val ala
123/41                                     153/51
GTC GCG CAG CTT GCG GAA ACG GGG TAT GGA CCC TGC CGT ACC GTT GTT GCC ACT TGA TGT
val ala gln leu ala glu thr gly tyr gly pro cys arg thr val val ala thr)OPA(cys
183/61                                     213/71         SEQ ID NO: 539
CGT CGC TCT CCA CCC GTC GGG GGG CGA AAG CCA TTC CGA CAC TGG GAT CCT CAA AAC GTC
arg arg ser pro pro val gly gly arg lys pro phe arg his trp asp pro gln asn val
243/81                                     273/91
GGC TGA GTG TCT GCA GGG CTC CGG GGA GCA GCC GAT CAT CAC CAT GTA CGA ACT GAA TAA
gly)OPA(val ser ala gly leu arg gly ala ala asp his his his val arg thr glu)OCH
303/101     SEQ ID NO: 540                 333/111
GTC CCC CCC GCG CGA CTT CCA GAC ATT TGT TGT GGT TTC GGT TGA GGC CGA GGC GAG GCT
(val pro pro ala arg leu pro asp ile cys cys gly phe gly)OPA(gly arg gly glu ala
363/121      SEQ ID NO: 541               393/131         SEQ ID NO: 542
CAT TTC GCA GCA AGC GGT CTC CGG GTC GCA GCA TCG TTG CGG CGA TCG CGG CGC AGT CGT
his phe ala ala ser gly leu arg val ala ala ser leu arg arg ser arg arg ser arg
423/141
CGG ACG AGT CGT CGT CAA CGA CCA CGA TC
arg thr ser arg arg gln arg pro arg)

SEQ ID NOS:537-541

FIG. 27C

SEQ ID NO: 543   MKTGTATTRRRLLAVLIALALPGAAVALLAEPSATGASDPCAASEVAR
TVGSVAKSMGDYLDSHPETNQVMTAVLQQQVGPGSVASLKAHFEANPK
VASDLHALSQPLTDLSTRCSLPISGLQAIGLMQAVQGARR

SEQ ID No.543

FIG. 28

SEQ ID NO: 544
GTGGGCAAGC AGCTAGCCGC GCTCGCCGCG CTGGTCGGTG CGTGCATGCT CGCAGCCGGA      60
TGCACCAACG TGGTCGACGG GACCGCCGTG GCTGCCGACA AATCCGGACC ACTGCATCAG     120
GATCCGATAC CGGTTTCAGC GCTTGAAGGG CTGCTTCTCG ACTTGAGCCA GATCAATGCC     180
GCGCTGGGTG CGACATCGAT GAAGGTGTGG TTCAACGCCA AGGCAATGTG GGACTGGAGC     240
AAGAGCGTGG CCGACAAGAA TTGCCTGGCT ATCGACGGTC CAGCACAGGA AAAGGTCTAT     300
GCCGGCACCG GGTGGACCGC TATGCGACGG CAACGGCTGG ATGACACAT CGATGACTCC      360
AAGAAACGCG ACCACTACGC CATTCAAGCG GTCGTGGCT TCCCGACCGC ACATGATGCC      420
GAGGAGTTCT ACAGCTCCTC GGTGCAAAGC TGGAGCAGCT GCTCGAACCG CCGGTTTGTC     480
GAAGTCACCC CCGGACAGGA CGACGCCGCC TGGACTGTGG CTGACGTTGT CAACGACAAC     540
GGCATGCTCA GTAGCTCGCA GGTTCAGGAA GGCGGCGACG GATGGACCTG CCAGCGTGCC     600
CTGACTGCGC GCAACAACGT CACTATCGAC ATTGTCACGT GCCTATAG CCAACCGGAT       660
TTGGTGGCGA TTGGCATCGC TAACCAAATC GCGGCCAAGG TTGCTAAGCA GTAG           714

SEQ ID No.544

FIG. 29

SEQ ID NO: 545
MGKQLAALAALVGACMLAAGCTNVVDGTAVAADKSGPLHQDPIPVFTSALEGLLLDLSQINAALGATS
MKVWFNAKAMWDWSKSVADKNCLAIDGPAQEKVYAGTGFTWTAMRGQRLDDSIDDSKKRDHYAIQAVV
GFPTAHDAEEFYSSSVQSWSSCSNRRFVEVTFTPGQDDAAWTVADVVNDNGMLSSSQVQEGGDGWTCQ
RALTARNNVTIDIVTCAYSQPDLVFTAIGIANQIAAKVAKQ

SEQ ID No.545

FIG. 30

```
1/1   SEQ ID NO: 546                      31/11
AGG CGA ATA CCC GCG AGG GCA GCG CGA CGG CGG CCC TGC CGG CGC CGT GGC TGC TGA ACA
(arg arg ile pro ala arg ala ala arg arg arg pro cys arg arg arg gly cys)OPA(thr
61/21  SEQ ID NO: 547                     91/31              SEQ ID NO: 548
ACA CAT CCC AGC CGC GCA CGC TTC GGT ATG CGG CAG GAT AAA CGA CCC AAC AGC AGA
thr his pro ser arg ala arg phe arg tyr ala ala gly)OCH(thr thr pro thr ala arg
121/41                                    151/51            SEQ ID NO: 549
ACA CCA GGA TTG CGA CAA CCA AAG CCC TCG CGC CTG GCT CGA TTT CGC GCG CAA CGC GGC
thr pro gly leu arg gln pro lys pro ser arg leu ala arg phe arg ala gln arg gly
181/61                                    211/71
GTT CTG CCG CCT CGA TCT CAG CGC GGA GGG CGT CGA GAT C
val leu pro pro arg ser gln arg gly gly arg arg asp)
```

SEQ ID NOS:546-549

FIG. 31A

```
1/1   SEQ ID NO: 550                      31/11
GGC GAA TAC CCG CGA GGG CAG CGC GAC GGC GGC CCT GCC GGC GCC GTG GCT GCT GAA CAA
(gly glu tyr pro arg gly gln arg asp gly gly pro ala gly ala val ala ala glu gln
61/21  SEQ ID NO: 551                     91/31
CAC ATC CCA GCC GCG CAC GCT TCC GGT ATG CGG CAG GAT AAA CGA CCC AAC AGC ACG AA
his ile pro ala ala his ala ser gly met arg gln asp lys arg pro gln gln his glu
121/41                                    151/51
CAC CAG GAT TGC GAC AAC CAA AGC CCT CGC GCC TGG CTC GAT TTC GCG CGC AAC GCG GCG
his gln asp cys asp asn gln ser pro arg ala trp leu asp phe ala arg asn ala ala
181/61                                    211/71
TTC TGC CGC CTC GAT CTC AGC GCG GAG GGC GTC GAG ATC
phe cys arg leu asp leu ser ala glu gly val glu ile)
```

SEQ ID NOS:550-551

FIG. 31B

1/1 — SEQ ID NO: 552                                  31/11
GCG AAT ACC CGC GAG GGC AGC GCG ACG GCG GCC CTG CCG GCG CCG TGG CTG CTG AAC AAC
(ala asn thr arg glu gly ser ala thr ala ala leu pro ala pro trp leu leu asn asn
61/21 — SEQ ID NO: 553                                91/31
ACA TCC CAG CCG CGC ACG CTT CCG GTA TGC GGC AGG ATA AAC GAC CCC AAC AGC ACG AAC
thr ser gln pro arg thr leu pro val cys gly arg ile asn asp pro asn ser thr asn
121/41                                                151/51
ACC AGG ATT GCG ACA ACC AAA GCC CTC GCG CCT GGC TCG ATT TCG CGC GCA ACG CGG CGT
thr arg ile ala thr thr lys ala leu ala pro gly ser ile ser arg ala thr arg arg
181/61                                                211/71
TCT GCC GCC TCG ATC TCA GCG CGG AGG GCG TCG AGA TC
ser ala ala ser ile ser ala arg arg ala ser arg)

SEQ ID NOS:552-553

FIG. 31C

ORF according to Cole et al. (Nature 393:537-544) and containing seq31A
1/1 — SEQ ID NO: 554                                  31/11
taa acg acc cca aca gca cga aca cca gga ttg cga caa cca aag ccc tcg cgc ctg gct
OCH(thr thr pro thr ala arg thr pro gly leu arg gln pro lys pro ser arg leu ala
61/21 — SEQ ID NO: 555                                91/31
cga ttt cgc gcg caa cgc ggc gtt ctg ccg cct cga tct cag cgc gga ggg cgt cga gat
arg phe arg ala gln arg gly val leu pro pro arg ser gln arg gly gly arg arg asp
121/41                                                151/51
ccc cgg cgt cgt gtt cgt ggc tca tca tct gca tcc tcc ggg ctt ggc cgc gct gac cgg
pro arg arg arg val arg gly ser ser ser ala ser ser gly leu gly arg ala asp arg
181/61                                                211/71
cag ccc gac ccc agg cat gcc cag gcc gac ggc gcg ccc cgg ctg ccc ggc ggt gtg cgc
gln pro asp pro arg his ala gln ala asp gly ala pro arg leu pro gly gly val arg
241/81                                                271/91
gtc gcc ggc gcg ggt gcg gcg gtg ggt cag gac gcc ggc gtc ggc gat gag gtg gtg cgg
val ala gly ala gly ala ala val gly gln asp ala gly val gly asp glu val val arg
301/101                                               331/111
cgc cgc ttc ggt gac ctt cgt ggt gat gac gtc gcc ggg acg cac gcg cgg ctg gcc ggc
arg arg phe gly asp leu arg gly asp asp val ala gly thr his ala arg leu ala gly
361/121                                               391/131
ggt gaa gtg cac cag gcg ccc gtc gcg cgc ccg ccc gct cat gcg cgc cgt gac ggt gtc
gly glu val his gln ala pro val ala arg pro pro ala his ala arg arg asp gly val
421/141                                               451/151
ctt gcg ccc ttc ccc ggt ggc cac cag cac ctc gac ggc ctg ccc gac cag ggc gcg gtt
leu ala pro phe pro gly gly his gln his leu asp gly leu pro asp gln gly ala val
481/161                                               511/171
ggc ttc cag cga gat ttg ctc ctg cag cgc gat cag gcg ttc ata gcg ttc ctg cac aac
gly phe gln arg asp leu leu leu gln arg asp gln ala phe ile ala phe leu his asn
541/181                                               571/191
ggc ttt cgg cag ctg tcc gtc gag ttg cgc ggc cgg tgt ccc ggg ccg ctt gga gta ttg
gly phe arg gln leu ser val glu leu arg gly arg cys pro gly pro leu gly val leu
601/201                                               631/211
gaa ggt aaa tgc ggc cgc gaa gcg ggc ccg cac cac gtc gag cgt ggc cgc gaa gtc
glu gly lys cys gly arg glu ala gly pro his his val glu arg gly arg glu val
661/221                                               691/231
ctc ttc ggt ctc ccc ggg gaa acc gac gat cag atc ggt ggt aat cgc ggc atg cgg gat
leu phe gly leu pro gly glu thr asp asp gln ile gly gly asn arg gly met arg asp
721/241                                               751/251
ggc cgc ccg cac gcg ctc gat gat gcc gag gta gcg ctc ggc acg ata gga ccg ccg cat
gly arg pro his ala leu asp asp ala glu val ala leu gly thr ile gly pro pro his
781/261                                               811/271
cgc gcg cag gat ccg gtc gga tcc gga ctg tag
arg ala gln asp pro val gly ser gly leu)AMB

SEQ ID NOS:554-555

FIG. 31D

```
1/1  SEQ ID NO: 556                        31/11
aga ctg gtg tac acg gag acc aag ctg aac tcg gca ttc tcc ttc ggc ggg cct aag tgt
(arg leu val tyr thr glu thr lys leu asn ser ala phe ser phe gly gly pro lys cys
61/21 SEQ ID NO: 557                       91/31
cta gtg aag gtc att cag aaa ctg tcg ggc ttg agc atc aac cgg ttc atc gcg att gac
leu val lys val ile gln lys leu ser gly leu ser ile asn arg phe ile ala ile asp
121/41                                     151/51
ttc gtc ggt ttc gcg cgg atg gtc gag gcc ctc ggc ggc gtc gag gta tgc agc acc acc
phe val gly phe ala arg met val glu ala leu gly gly val glu val cys ser thr thr
181/61                                     211/71
ccg ttg cgg gac tac gaa ctg ggc acg gtg ctg gag cac gcc gga cgc cag gtc att gac
pro leu arg asp tyr glu leu gly thr val leu glu his ala gly arg gln val ile asp
241/81                                     271/91
ggg ccg acc gcg ctg aac tat gtg cgc gct cgc cag gtc acc acc gag agc aat ggc gac
gly pro thr ala leu asn tyr val arg ala arg gln val thr thr glu ser asn gly asp
301/101                                    331/111
tac ggg cgc atc aaa cgc cag cag ttg ttt ttg tcg tcg ctg ctg cgt tcg atg atc
tyr gly arg ile lys arg gln gln leu phe leu ser ser leu leu arg ser met ile)
```

SEQ ID NOS:556-557

FIG. 32A

```
1/1  SEQ ID NO: 558                        31/11
gac tgg tgt aca cgg aga cca agc tga act cgg cat tct cct tcg gcg ggc cta agt gtc
(asp trp cys thr arg arg pro ser)OPA(thr arg his ser pro ser ala gly leu ser val)
61/21 SEQ ID NO: 559  SEQ ID NO: 560        91/31
tag tga agg tca ttc aga aac tgt cgg ctg aca tca acc ggt tca tcg cga ttg act
AMB OPA(arg ser phe arg asn cys arg ala)OPA(ala ser thr gly ser ser arg leu thr
121/41      SEQ ID NO: 561                 151/51   SEQ ID NO: 562
tcg tcg gtt tcg cgc gga tgg tcg agg ccc tcg gcg gcg tcg agg tat gca gca cca ccc
ser ser val ser arg gly trp ser arg pro ser ala ala ser arg tyr ala ala pro pro
181/61                                     211/71
cgt tgc ggg act acg aac tgg gca cgg tcg tgg agc acg ccg gac gcc agg tca ttg acg
arg cys gly thr thr asn trp ala arg cys trp ser thr pro asp ala arg ser leu thr
241/81                                     271/91
ggc cga ccg cgc tga act atg tgc gcg ctc gcc agg tca cca ccg aga gca atg gcg act
gly arg pro arg)OPA(thr met cys ala leu ala arg ser pro pro arg ala met ala thr
301/101      SEQ ID NO: 563                331/111
acg ggc gca tca aac gcc agc agt tgt ttt tgt cgt cgc tgc tgc gtt cga tga tc
thr gly ala ser asn ala ser ser cys phe cys arg arg cys cys val arg)OPA
```

SEQ ID NOS:558-563

FIG. 32B

1/1  SEQ ID NO:564                          31/11
act ggt gta cac gga gac caa gct gaa ctc ggc att ctc ctt cgg cgg gcc taa gtg tct
(thr gly val his gly asp gln ala glu leu gly ile leu leu arg arg ala)OCH(val ser
61/21  SEQ ID NO: 565                       91/31                SEQ ID NO: 566
agt gaa ggt cat tca gaa act gtc ggg ctt gag cat caa ccg gtt cat cgc gat tga ctt
ser glu gly his ser glu thr val gly leu glu his gln pro val his arg asp)OP(leu
121/41                                      151/51               SEQ ID NO: 567
cgt cgg ttt cgc gcg gat ggt cga ggc cct cgg cgg cgt cga ggt atg cag cac cac ccc
arg arg phe arg ala asp gly arg gly pro arg arg arg arg gly met gln his his pro
181/61                                      211/71
gtt gcg gga cta cga act ggg cac ggt gct gga gca cgc gga acg cca ggt cat tga cgg
val ala gly leu arg thr gly his gly ala gly ala arg arg thr pro gly his)OPA(arg
241/81                                      271/91                SEQ ID NO: 568
gcc gac cgc gct gaa cta tgt gcg cgc tcg cca ggt cac cac cga gag caa tgg cga cta
ala asp arg ala glu leu cys ala arg ser pro gly his his arg glu gln trp arg leu
301/101                                     331/111
cgg gcg cat caa acg cca gca gtt gtt ttt gtc gtc gct gct gcg ttc gat gat c
arg ala his gln thr pro ala val val phe val val ala ala ala phe asp asp)

SEQ ID NOS:564-568

FIG. 32C sequence Rv0822c predicted by Cole et al. (Nature 393:537-544) and containing
seq 32A 1/1  SEQ ID NO: 569                         31/11
atg agt gac ggc gag agc gcc gcg ccg tgg gca cgg ctc tcc gag tca gca ttc ccc gat
(Met ser asp gly glu ser ala ala pro trp ala arg leu ser glu ser ala phe pro asp
61/21  SEQ ID NO: 570                       91/31
ggt gtt gac cga tgg atc acg gta ccg ccc gcc aca tgg gtg gca gcc cag ggt ccg cgg
gly val asp arg trp ile thr val pro pro ala thr trp val ala ala gln gly pro arg
121/41                                      151/51
gac acc cag aat gtc ggc tgt cat gcc acc ggc gcc gtt agt gtg gcc gat ctg atc gcc
asp thr gln asn val gly cys his ala thr gly ala val ser val ala asp leu ile ala
181/61                                      211/71
agg ctc ggc ccc gct ttt cct gac ctc ccc acg cac cgc cat gtc gcc ccc gaa ccc gag
arg leu gly pro ala phe pro asp leu pro thr his arg his val ala pro glu pro glu
241/81                                      271/91
cca tcc ggc cgc ggc ccg aag gtc cac gac gac gcc gac gac cag cag gac acc gag gct
pro ser gly arg gly pro lys val his asp asp ala asp asp gln gln asp thr glu ala
301/101                                     331/111
atc gcc atc ccg gcc cac tcg ctc gag ttc ctc tcg gag ctt ccc gac ctc cgg gca gcc
ile ala ile pro ala his ser leu glu phe leu ser glu leu pro asp leu arg ala ala
361/121                                     391/131
aac tat ccg cgc gcc gac cac gcc cgc cgt gaa ccc gag cta ccc ggc aag cag cta acc
asn tyr pro arg ala asp his ala arg arg glu pro glu leu pro gly lys gln leu thr
421/141                                     451/151
gga tcg gct cga gtg cgg cca ttg cgg atc cgc cga acg tcg ccc gcg ccc gcc aag cca
gly ser ala arg val arg pro leu arg ile arg arg thr ser pro ala pro ala lys pro
481/161                                     511/171
gcg ccg aac tcc ggc cgg cgc ccg atg gtg ctg gcc gcg cgc tcg ctg gcg gct ctg ttt
ala pro asn ser gly arg arg pro met val leu ala ala arg ser leu ala ala leu phe
541/181                                     571/191
gcc gct ctg gcg ttg gcg ctg acc ggc ggg gca tgg cag tgg agc gcg tcg aag aac agc
ala ala leu ala leu ala leu thr gly gly ala trp gln trp ser ala ser lys asn ser
601/201                                     631/211
cgg ctg aac atg gta agc gcg ctc gac ccg cat tcg ggc gac atc gtc aac ccc agc ggg
arg leu asn met val ser ala leu asp pro his ser gly asp ile val asn pro ser gly

SEQ ID NOS:569-570

FIG. 32D

```
661/221                                       691/231
cag cat ggc gac gag aac ttc ttg ctc gtc      ggt atg gac tct cgt gcc ggg gcg aac gcc
gln his gly asp glu asn phe leu leu val      gly met asp ser arg ala gly ala asn ala
721/241                                       751/251
aat atc ggc gcc ggc gac gcc gag gac gcc      ggc ggc gca cgt tcg gac acc gtc atg ctg
asn ile gly ala gly asp ala glu asp ala      gly gly ala arg ser asp thr val met leu
781/261                                       811/271
gtc aac att ccg gcc agc cgc gag cgg gtc      gtc gcg gtg tcg ttc ccc cgc gac ctg gcg
val asn ile pro ala ser arg glu arg val      val ala val ser phe pro arg asp leu ala
841/281                                       871/291
atc act cca atc caa tgc gag gcg tgg aac      ccc gag acc ggt aag tac gga ccc atc tac
ile thr pro ile gln cys glu ala trp asn      pro glu thr gly lys tyr gly pro ile tyr
901/301                                       931/311
gac gag aag acg gga acg atg ggt ccc aga      ctg gtg tac acg gag acc aag ctg aac tcg
asp glu lys thr gly thr met gly pro arg      leu val tyr thr glu thr lys leu asn ser
961/321                                       991/331
gca ttc tcc ttc ggc ggg cct aag tgt cta      gtg aag gtc att cag aaa ctg tcg ggc ttg
ala phe ser phe gly gly pro lys cys leu      val lys val ile gln lys leu ser gly leu
1021/341                                      1051/351
agc atc aac cgg ttc atc gcg att gac ttc      gtc ggt ttc gcg cgg atg gtc gag gcc ctc
ser ile asn arg phe ile ala ile asp phe      val gly phe ala arg met val glu ala leu
1081/361                                      1111/371
ggc ggc gtc gag gta tgc agc acc acc ccg      ttg cgg gac tac gaa ctg ggc acg gtg ctg
gly gly val glu val cys ser thr thr pro      leu arg asp tyr glu leu gly thr val leu
1141/381                                      1171/391
gag cac gcc gga cgc cag gtc att gac ggg      ccg acc gcg ctg aac tat gtg cgc gct cgc
glu his ala gly arg gln val ile asp gly      pro thr ala leu asn tyr val arg ala arg
1201/401                                      1231/411
cag gtc acc acc gag agc aat ggc gac tac      ggg cgc atc aaa cgc cag cag ttg ttt ttg
gln val thr thr glu ser asn gly asp tyr      gly arg ile lys arg gln gln leu phe leu
1261/421                                      1291/431
tcg tcg ctg ctg cgt tcg atg atc tcg acg      gac acc ttg ttc aac ctc agc agg ctc aac
ser ser leu leu arg ser met ile ser thr      asp thr leu phe asn leu ser arg leu asn
1321/441                                      1351/451
aac gtc gtc aac atg ttc atc ggt aac agc      tac gtg gac aac gtc aag acc aaa gac ctg
asn val val asn met phe ile gly asn ser      tyr val asp asn val lys thr lys asp leu
1381/461                                      1411/471
gtc gaa ctc ggt cga tcg ttg cag cat atg      gcg gcc ggg cac gtc acg ttc gtg acc gtt
val glu leu gly arg ser leu gln his met      ala ala gly his val thr phe val thr val
1441/481                                      1471/491
ccg acc ggt ata acc gac cag aac ggc gac      gag ccc ccg cgt acc tcc gac atg aag gcg
pro thr gly ile thr asp gln asn gly asp      glu pro pro arg thr ser asp met lys ala
1501/501                                      1531/511
ctt ttc acc gcc atc atc gac gac gat ccg      ctg ccc ctg gaa aac gat cac aac gcc cag
leu phe thr ala ile ile asp asp asp pro      leu pro leu glu asn asp his asn ala gln
1561/521                                      1591/531
cgt ctg ggc aac acg ccg tcg acc ccg ccg      acc acc aag aag gcg ccg cag gcg ggt
arg leu gly asn thr pro ser thr pro pro      thr thr thr lys lys ala pro gln ala gly
1621/541                                      1651/551
ctg acc aac gag att cag cac cag cag gtt      acg acg acc tcg cca aaa gag gtc aca gtg
leu thr asn glu ile gln his gln gln val      thr thr thr ser pro lys glu val thr val
1681/561                                      1711/571
cag gtc tct aac tcg acc ggc cag gcc ggt      ttg gcc acc acc gcc acc gat cag ctc aag
gln val ser asn ser thr gly gln ala gly      leu ala thr thr ala thr asp gln leu lys
1741/581                                      1771/591
cgg aac ggc ttc aac gtg atg gct ccg gac      gac tac ccg agt tcg ctg ctg gcc acc aca
arg asn gly phe asn val met ala pro asp      asp tyr pro ser ser leu leu ala thr thr
1801/601                                      1831/611
gtg ttt ttt tcg ccc ggc aac gaa cag gct      gcc gcc acc gtg gcc gcc gtg ttc ggc cag
val phe phe ser pro gly asn glu gln ala      ala ala thr val ala ala val phe gly gln
1861/621                                      1891/631
tca aag atc gag cgg gtg acc ggg atc ggc      caa ctg gtc cag gtg gtg ctg ggc caa gac
ser lys ile glu arg val thr gly ile gly      gln leu val gln val val leu gly gln asp
```

SEQ ID NOS:569-570 (continued 1)

1921/641
ttc agc gcg gtg cgc gct ccc ctg ccg agt
phe ser ala val arg ala pro leu pro ser
1981/661
aac tcc tcc agc cca ccg acc aag ctg ccc
asn ser ser ser pro pro thr lys leu pro
2041/681
acc acc tgc gag tag
thr thr cys glu)AMB 1951/651
ggc tcc acc gtc agc gtg cag ata agc cgc
gly ser thr val ser val gln ile ser arg
2011/671
gag gac ctg acg gtc acc aac gcc gcc gac
glu asp leu thr val thr asn ala ala asp SEQ ID NOS:569-570 (continued 2)

FIG. 32D (continued 2)

ORF according to Cole et al. (Nature 393:537-544) and containing Rv0822c

1/1 — SEQ ID NO: 571
tag gac atg agt gac ggc gag agc gcc gcg
AMB(asp met ser asp gly glu ser ala ala
61/21 — SEQ ID NO: 572
ccc gat ggt gtt gac cga tgg atc acg gta
pro asp gly val asp arg trp ile thr val
121/41
ccg cgg gac acc cag aat gtc ggc tgt cat
pro arg asp thr gln asn val gly cys his
181/61
atc gcc agg ctc ggc ccc gct ttt cct gac
ile ala arg leu gly pro ala phe pro asp
241/81
ccc gag cca tcc ggc cgc ggc ccg aag gtc
pro glu pro ser gly arg gly pro lys val
301/101
gag gct atc gcc atc ccg gcc cac tcg ctc
glu ala ile ala ile pro ala his ser leu
361/121
gca gcc aac tat ccg cgc gcc gac cac gcc
ala ala asn tyr pro arg ala asp his ala
421/141
cta acc gga tcg gct cga gtg cgg cca ttg
leu thr gly ser ala arg val arg pro leu
481/161
aag cca gcg ccg aac tcc ggc cgg cgc ccg
lys pro ala pro asn ser gly arg arg pro
541/181
ctg ttt gcc gct ctg gcg ttg gcg ctg acc
leu phe ala ala leu ala leu ala leu thr
601/201
aac agc cgg ctg aac atg gta agc gcg ctc
asn ser arg leu asn met val ser ala leu
661/221
agc ggg cag cat ggc gac gag aac ttc ttg
ser gly gln his gly asp glu asn phe leu
721/241
aac gcc aat atc ggc gcc ggc gac gcc gag
asn ala asn ile gly ala gly asp ala glu
781/261
atg ctg gtc aac att ccg gcc agc cgc gag
met leu val asn ile pro ala ser arg glu 31/11
ccg tgg gca cgg ctc tcc gag tca gca ttc
pro trp ala arg leu ser glu ser ala phe
91/31
ccg ccc gcc aca tgg gtg gca gcc cag ggt
pro pro ala thr trp val ala ala gln gly
151/51
gcc acc ggc gcc gtt agt gtg gcc gat ctg
ala thr gly ala val ser val ala asp leu
211/71
ctc ccc acg cac cgc cat gtc gcc ccc gaa
leu pro thr his arg his val ala pro glu
271/91
cac gac gac gcc gac gac cag cag gac acc
his asp asp ala asp asp gln gln asp thr
331/111
gag ttc ctc tcg gag ctt ccc gac ctc cgg
glu phe leu ser glu leu pro asp leu arg
391/131
cgc cgt gaa ccc gag cta ccc ggc aag cag
arg arg glu pro glu leu pro gly lys gln
451/151
cgg atc cgc cga acg tcg ccc gcg ccc gcc
arg ile arg arg thr ser pro ala pro ala
511/171
atg gtg ctg gcc gcg cgc tcg ctg gcg gct
met val leu ala ala arg ser leu ala ala
571/191
ggc ggg gca tgg cag tgg agc gcg tcg aag
gly gly ala trp gln trp ser ala ser lys
631/211
gac ccg cat tcg ggc gac atc gtc aac ccc
asp pro his ser gly asp ile val asn pro
691/231
ctc gtc ggt atg gac tct cgt gcc ggg gcg
leu val gly met asp ser arg ala gly ala
751/251
gac gcc ggc ggc gca cgt tcg gac acc gtc
asp ala gly gly ala arg ser asp thr val
811/271
cgg gtc gtc gcg gtg tcg ttc ccc cgc gac
arg val val ala val ser phe pro arg asp

SEQ ID NOS: 571-572

FIG. 32E

```
841/281                                      871/291
ctg gcg atc act cca atc caa tgc gag gcg      tgg aac ccc gag acc ggt aag tac gga ccc
leu ala ile thr pro ile gln cys glu ala      trp asn pro glu thr gly lys tyr gly pro
901/301                                      931/311
atc tac gac gag aag acg gga acg atg ggt      ccc aga ctg gtg tac acg gag acc aag ctg
ile tyr asp glu lys thr gly thr met gly      pro arg leu val tyr thr glu thr lys leu
961/321                                      991/331
aac tcg gca ttc tcc ttc ggc ggg cct aag      tgt cta gtg aag gtc att cag aaa ctg tcg
asn ser ala phe ser phe gly gly pro lys      cys leu val lys val ile gln lys leu ser
1021/341                                     1051/351
ggc ttg agc atc aac cgg ttc atc gcg att      gac ttc gtc ggt ttc gcg cgg atg gtc gag
gly leu ser ile asn arg phe ile ala ile      asp phe val gly phe ala arg met val glu
1081/361                                     1111/371
gcc ctc ggc ggc gtc gag gta tgc agc acc      acc ccg ttg cgg gac tac gaa ctg ggc acg
ala leu gly gly val glu val cys ser thr      thr pro leu arg asp tyr glu leu gly thr
1141/381                                     1171/391
gtg ctg gag cac gcc gga cgc cag gtc att      gac ggg ccg acc gcg ctg aac tat gtg cgc
val leu glu his ala gly arg gln val ile      asp gly pro thr ala leu asn tyr val arg
1201/401                                     1231/411
gct cgc cag gtc acc acc gag agc aat ggc      gac tac ggg cgc atc aaa cgc cag cag ttg
ala arg gln val thr thr glu ser asn gly      asp tyr gly arg ile lys arg gln gln leu
1261/421                                     1291/431
ttt ttg tcg tcg ctg ctg cgt tcg atg atc      tcg acg gac acc ttg ttc aac ctc agc agg
phe leu ser ser leu leu arg ser met ile      ser thr asp thr leu phe asn leu ser arg
1321/441                                     1351/451
ctc aac aac gtc gtc aac atg ttc atc ggt      aac agc tac gtg gac aac gtc aag acc aaa
leu asn asn val val asn met phe ile gly      asn ser tyr val asp asn val lys thr lys
1381/461                                     1411/471
gac ctg gtc gaa ctc ggt cga tcg ttg cag      cat atg gcg gcc ggg cac gtc acg ttc gtg
asp leu val glu leu gly arg ser leu gln      his met ala ala gly his val thr phe val
1441/481                                     1471/491
acc gtt ccg acc ggt ata acc gac cag aac      ggc gac gag ccc ccg cgt acc tcc gac atg
thr val pro thr gly ile thr asp gln asn      gly asp glu pro pro arg thr ser asp met
1501/501                                     1531/511
aag gcg ctt ttc acc gcc atc atc gac gac      gac ccg ctg ccc ctg gaa aac gat cac aac
lys ala leu phe thr ala ile ile asp asp      asp pro leu pro leu glu asn asp his asn
1561/521                                     1591/531
gcc cag cgt ctg ggc aac acg ccg tcg acc      ccg ccg acc acc aag aag gcg ccg cag
ala gln arg leu gly asn thr pro ser thr      pro pro thr thr lys lys ala pro gln
1621/541                                     1651/551
gcg ggt ctg acc aac gag att cag cac cag      cag gtt acg acg acc tcg cca aaa gag gtc
ala gly leu thr asn glu ile gln his gln      gln val thr thr thr ser pro lys glu val
1681/561                                     1711/571
aca gtg cag gtc tct aac tcg acc ggc cag      gcc ggt ttg gcc acc acc gcc acc gat cag
thr val gln val ser asn ser thr gly gln      ala gly leu ala thr thr ala thr asp gln
1741/581                                     1771/591
ctc aag cgg aac ggc ttc aac gtg atg gct      ccg gac gac tac ccg agt tcg ctg ctg gcc
leu lys arg asn gly phe asn val met ala      pro asp asp tyr pro ser ser leu leu ala
1801/601                                     1831/611
acc aca gtg ttt ttt tcg ccc ggc aac gaa      cag gct gcc gcc acc gtg gcc gcc gtg ttc
thr thr val phe phe ser pro gly asn glu      gln ala ala ala thr val ala ala val phe
1861/621                                     1891/631
ggc cag tca aag atc gag cgg gtg acc ggg      atc ggc caa ctg gtc cag gtg gtg ctg ggc
gly gln ser lys ile glu arg val thr gly      ile gly gln leu val gln val val leu gly
1921/641                                     1951/651
caa gac ttc agc gcg gtg cgc gct ccc ctg      ccg agt ggc tcc acc gtc agc gtg cag ata
gln asp phe ser ala val arg ala pro leu      pro ser gly ser thr val ser val gln ile
1981/661                                     2011/671
agc cgc aac tcc tcc agc cca ccg acc aag      ctg ccc gag gac ctg acg gtc acc aac gcc
ser arg asn ser ser ser pro pro thr lys      leu pro glu asp leu thr val thr asn ala
2041/681
gcc gac acc acc tgc gag tag
ala asp thr thr cys glu)AMB
```

SEQ ID NOS: 571-572 (continued 1)

FIG. 32E (continued 1)

```
1/1   SEQ ID NO: 573                        31/11
CGT CAC CTC TGC CAT GGT CCA TCT ACG GTA TCT GCG ACA AGG GCA GCG TCG ATC CCT CGA
(arg his leu cys his gly pro ser thr val ser ala thr arg ala ala ser ile pro arg
61/21   SEQ ID NO: 574                     91/31
CAT GCA GAG TCG GTG TTC GCT TCA CGC GAA CTA GGC GCG CCT AGC CTG GAC GAG TCC CCG
his ala glu ser val phe ala ser arg glu leu gly ala pro ser leu asp glu ser pro
121/41                                    151/51
GGC CGA CAT TCG CCC GAG GCC TTG GCC TCC ATC ACC TAA TTG TGT GCA AAA CCG TAT CTA
gly arg his ser pro glu ala leu ala ser ile thr)OCH(leu cys ala lys pro tyr leu
181/61                                    211/71       SEQ ID NO: 575
ATT GAT ACG ATT GCG CAC ATG GCT ATC TGG GAT C
ile asp thr ile ala his met ala ile trp asp)
```

SEQ ID NOS:573-575

FIG. 33A

```
1/1   SEQ ID NO: 576                        31/11
GTC ACC TCT GCC ATG GTC CAT CTA CGG TAT CTG CGA CAA GGG CAG CGT CGA TCC CTC GAC
(val thr ser ala met val his leu arg tyr leu arg gln gly gln arg arg ser leu asp
61/21   SEQ ID NO: 577                     91/31
ATG CAG AGT CGG TGT TCG CTT CAC GCG AAC TAG GCG CGC CTA GCC TGG ACG AGT CCC CGG
met gln ser arg cys ser leu his ala asn)AMB(ala arg leu ala trp thr ser pro arg
121/41                                    151/51    SEQ ID NO: 578
GCC GAC ATT CGC CCG AGG CCT TGG CCT CCA TCA CCT AAT TGT GTG CAA AAC CGT ATC TAA
ala asp ile arg pro arg pro trp pro pro ser pro asn cys val gln asn arg ile)OCH
181/61                                    211/71
TTG ATA CGA TTG CGC ACA TGG CTA TCT GGG ATC
(leu ile arg leu arg thr trp leu ser gly ile)
  SEQ ID NO: 579
```

SEQ ID NOS:576-579

FIG. 33B

```
1/1   SEQ ID NO: 580                        31/11
CCG TCA CCT CTG CCA TGG TCC ATC TAC GGT ATC TGC GAC AAG GGC AGC GTC GAT CCC TCG
(pro ser pro leu pro trp ser ile tyr gly ile cys asp lys gly ser val asp pro ser
61/21       SEQ ID NO: 581                 91/31
ACA TGC AGA GTC GGT GTT CGC TTC ACG CGA ACT AGG CGC CTA GCC TGG ACG AGT CCC
thr cys arg val gly val arg phe thr arg thr arg arg ala)AMB(pro gly arg val pro
121/41                                    151/51       SEQ ID NO: 582
GGG CCG ACA TTC GCC CGA GGC CTT GGC CTC CAT CAC CTA ATT GTG TGC AAA ACC GTA TCT
gly pro thr phe ala arg gly leu gly leu his his leu ile val cys lys thr val ser
181/61                                    211/71
AAT TGA TAC GAT TGC GCA CAT GGC TAT CTG GGA TC
asn)OPA(tyr asp cys ala his gly tyr leu gly)
       SEQ ID NO: 583
```

SEQ ID NOS:580-583

FIG. 33C sequence Rv1044 predicted by Cole et al. (Nature 393:537-544) and
containing seq33A 1/1 SEQ ID NO: 584                          31/11
ttg tgt gca aaa ccg tat cta att gat acg att gcg cac atg gct atc tgg gat cgc ctc
(leu cys ala lys pro tyr leu ile asp thr ile ala his met ala ile trp asp arg leu
61/21  SEQ ID NO: 585                       91/31
gtc gag gtt gcc gcc gag caa cat ggc tac gtc acg act cgc gat gcg cga gac atc ggc
val glu val ala ala glu gln his gly tyr val thr thr arg asp ala arg asp ile gly
121/41                                      151/51
gtc gac cct gtg cag ctc cgc ctc cta gcg ggg cgc gga cgt ctt gag cgt gtc ggc cga
val asp pro val gln leu arg leu leu ala gly arg gly arg leu glu arg val gly arg
181/61                                      211/71
ggt gtg tac cgg gtg ccc gtg ctg ccg cgt ggt gag cac gac gat ctc gca gcc gca gtg
gly val tyr arg val pro val leu pro arg gly glu his asp asp leu ala ala ala val
241/81                                      271/91
tcg tgg act ttg ggg cgt ggc gtt atc tcg cat gag tcg gcc ttg gcg ctt cat gcc ctc
ser trp thr leu gly arg gly val ile ser his glu ser ala leu ala leu his ala leu
301/101                                     331/111
gct gac gtg aac ccg tcg cgc atc cat ctc acc gtc ccg cgc aac aac cat ccg cgt gcg
ala asp val asn pro ser arg ile his leu thr val pro arg asn asn his pro arg ala
361/121                                     391/131
gcc ggg ggc gag ctg tac cga gtt cac cgc cgc gac ctc cag gca gcc cac gtc act tcg
ala gly gly glu leu tyr arg val his arg arg asp leu gln ala ala his val thr ser
421/141                                     451/151
gtc gac gga ata ccc gtc acg acg gtt gcg cgc acc atc aaa gac tgc gtg aag acg ggc
val asp gly ile pro val thr thr val ala arg thr ile lys asp cys val lys thr gly
481/161                                     511/171
acg gat cct tat cag ctt cgg gcc gcg atc gag cga gcc gaa gcc gag ggc acg ctt cgt
thr asp pro tyr gln leu arg ala ala ile glu arg ala glu ala glu gly thr leu arg
541/181                                     571/191
cgt ggg tca gca gct gag cta cgc gct gcg ctc gat gag acc act gcc gga tta cgc gct
arg gly ser ala ala glu leu arg ala ala leu asp glu thr thr ala gly leu arg ala
601/201
cgg ccg aag cga gca tcg gcg tga
arg pro lys arg ala ser ala)OPA

SEQ ID NOS:584-585

FIG. 33D

ORF according to Cole et al. (Nature 393:537-544) and containing Rv1044

1/1 SEQ ID NO: 586                               31/11
taa ttg tgt gca aaa ccg tat cta att gat acg att gcg cac atg gct atc tgg gat cgc
OCH(leu cys ala lys pro tyr leu ile asp thr ile ala his met ala ile trp asp arg
61/21 SEQ ID NO: 587                             91/31
ctc gtc gag gtt gcc gcc gag caa cat ggc tac gtc acg act cgc gat gcg cga gac atc
leu val glu val ala ala glu gln his gly tyr val thr thr arg asp ala arg asp ile
121/41                                           151/51
ggc gtc gac cct gtg cag ctc cgc ctc cta gcg ggg cgc gga cgt ctt gag cgt gtc ggc
gly val asp pro val gln leu arg leu leu ala gly arg gly arg leu glu arg val gly
181/61                                           211/71
cga ggt gtg tac cgg gtg ccc gtg ctg ccg cgt ggt gag cac gac gat ctc gca gcc gca
arg gly val tyr arg val pro val leu pro arg gly glu his asp asp leu ala ala ala
241/81                                           271/91
gtg tcg tgg act ttg ggg cgt ggc gtt atc tcg cat gag tcg gcc ttg gcg ctt cat gcc
val ser trp thr leu gly arg gly val ile ser his glu ser ala leu ala leu his ala
301/101                                          331/111
ctc gct gac gtg aac ccg tcg cgc atc cat ctc acc gtc ccg cgc aac aac cat ccg cgt
leu ala asp val asn pro ser arg ile his leu thr val pro arg asn asn his pro arg
361/121                                          391/131
gcg gcc ggg ggc gag ctg tac cga gtt cac cgc cgc gac ctc cag gca gcc cac gtc act
ala ala gly gly glu leu tyr arg val his arg arg asp leu gln ala ala his val thr
421/141                                          451/151
tcg gtc gac gga ata ccc gtc acg acg gtt gcg cgc acc atc aaa gac tgc gtg aag acg
ser val asp gly ile pro val thr thr val ala arg thr ile lys asp cys val lys thr
481/161                                          511/171
ggc acg gat cct tat cag ctt cgg gcc gcg atc gag cga gcc gaa gcc gag ggc acg ctt
gly thr asp pro tyr gln leu arg ala ala ile glu arg ala glu ala glu gly thr leu
541/181                                          571/191
cgt cgt ggg tca gca gct gag cta cgc gct gcg ctc gat gag acc act gcc gga tta cgc
arg arg gly ser ala ala glu leu arg ala ala leu asp glu thr thr ala gly leu arg
601/201
gct cgg ccg aag cga gca tcg gcg tga
ala arg pro lys arg ala ser ala)OPA

SEQ ID NOS:586-587

FIG. 33E

1/1 SEQ ID NO: 588                               31/11
ATC CAA CCT GCT GGG CCT GCG CCT TCG AAT CGA CGG CCA GGC CAC CGC TCG CTG CCG GCA
(ile gln pro ala gly pro ala pro ser asn arg arg pro gly his arg ser leu pro ala
61/21 SEQ ID NO: 589                             91/31
ACA ACA CCT GGA ATG GGG ACC TTT TCG GTG TTG CTG GTA ACC GGG ACA ACC GGC ACC ACG
thr thr pro gly met gly thr phe ser val leu leu val thr gly thr thr gly thr thr
121/41                                           151/51
CCT CGG TCG AGA CGT ATC GCG GCA GCG TTG GCC CTG TCG TTG CTG ACA ATT ACC GCT GGC
pro arg ser arg arg ile ala ala ala leu ala leu ser leu leu thr ile thr ala gly
181/61                                           211/71
CGC CGC ATA TTT GCC GCG CTG CCG CGG GCC GGA TC
arg arg ile phe ala ala leu pro arg ala gly)

SEQ ID NOS:588-589

FIG. 34A

```
1/1   SEQ ID NO: 590                    31/11
TCC AAC CTG CTG GGC CTG CGC CTT CGA ATC GAC GGC CAG GCC ACC GCT CGC TGC CGG CAA
(ser asn leu leu gly leu arg leu arg ile asp gly gln ala thr ala arg cys arg gln
61/21   SEQ ID NO: 591                  91/31
CAA CAC CTG GAA TGG GGA CCT TTT CGG TGT TGC TGG TAA CCG GGA CAA CCG GCA CCA CGC
gln his leu glu trp gly pro phe arg cys cys trp)OCH(pro gly gln pro ala pro arg
121/41                                  151/51        SEQ ID NO: 592
CTC GGT CGA GAC GTA TCG CGG CAG CGT TGG CCC TGT CGT TGC TGA CAA TTA CCG CTG GCC
leu gly arg asp val ser arg gln arg trp pro cys arg cys)OPA(gln leu pro leu ala
181/61                                  211/71         SEQ ID NO: 593
GCC GCA TAT TTG CCG CGC TGC CGC GGG CCG GAT C
ala ala tyr leu pro arg cys arg gly pro asp)
```

SEQ ID NOS:590-593

FIG. 34B

```
1/1    SEQ ID NO: 594                   31/11
GAT CCA ACC TGC TGG GCC TGC GCC TTC GAA TCG ACG GCC AGG CCA CCG CTC GCT GCC GGC
(asp pro thr cys trp ala cys ala phe glu ser thr ala arg pro pro leu ala ala gly
61/21    SEQ ID NO: 595                 91/31
AAC AAC ACC TGG AAT GGG GAC CTT TTC GGT GTT GCT GGT AAC CGG GAC AAC CGG CAC CAC
asn asn thr trp asn gly asp leu phe gly val ala gly asn arg asp asn arg his his
121/41                                  151/51
GCC TCG GTC GAG ACG TAT CGC GGC AGC GTT GGC CCT GTC GTT GCT GAC AAT TAC CGC TGG
ala ser val glu thr tyr arg gly ser val gly pro val val ala asp asn tyr arg trp
181/61                                  211/71
CCG CCG CAT ATT TGC CGC GCT GCC GCG GGC CGG ATC
pro pro his ile cys arg ala ala ala gly arg ile)
```

SEQ ID NOS:594-595

FIG. 34C

ORF according to Cole et al. (Nature 393:537-544) containing seq34A

1/1 SEQ ID NO: 596                                31/11
tag ccg cag ggc cct gcg gct agg cgc ggc cgg tgc cgt tgg ccg cgg cgg caa tcg atg
AMB(pro gln gly pro ala ala arg arg gly arg cys arg trp pro arg arg gln ser met
61/21  SEQ ID NO: 597                              91/31
ttg cag cag tta caa cgc caa atg gag tct gag cgc atc gtc gag ttc gat cag ctc ggc
leu gln gln leu gln arg gln met glu ser glu arg ile val glu phe asp gln leu gly
121/41                                            151/51
agg gga gac gtt gcg cag cga cgg atc caa cct gct ggg cct gcg cct tcg aat cga cgg
arg gly asp val ala gln arg arg ile gln pro ala gly pro ala pro ser asn arg arg
181/61                                            211/71
cca ggc cac cgc tcg ctg ccg gca aca aca cct gga atg ggg acc ttt tcg gtg ttg ctg
pro gly his arg ser leu pro ala thr thr pro gly met gly thr phe ser val leu leu
241/81                                            271/91
gta acc ggg aca acc ggc acc acg cct cgg tcg aga cgt atc gcg gca gcg ttg gcc ctg
val thr gly thr thr gly thr thr pro arg ser arg arg ile ala ala ala leu ala leu
301/101                                           331/111
tcg ttg ctg aca att acc gct ggc cgc cgc ata ttt gcc gcg ctg ccg cgg gcc gga tcc
ser leu leu thr ile thr ala gly arg arg ile phe ala ala leu pro arg ala gly ser
361/121                                           391/131
agg tcg acc tgc cag atc tca ccg cgc agc atc tac gcc gtt cgc tgc aaa ccg ccg act
arg ser thr cys gln ile ser pro arg ser ile tyr ala val arg cys lys pro pro thr
421/141                                           451/151
gcg acg gca ggc cca ctc tct tgg cat gcg tcc aat gct gcg acg tcc tcg gta gac aag
ala thr ala gly pro leu ser trp his ala ser asn ala ala thr ser ser val asp lys
481/161                                           511/171
ctc acg ctt ggc ttc atg ccg cag tcc tac cca tgt agt aac aga tag
leu thr leu gly phe met pro gln ser tyr pro cys ser asn arg)AMB

SEQ ID NOS:596-597

FIG. 34E

1/1 SEQ ID NO: 598                                31/11
CAG TCT GTC GGC AAG GAG GGA CGC ATG CCA CTC TCC GAT CAT GAG CAG CGG ATG CTT GAC
(gln ser val gly lys glu gly arg met pro leu ser asp his glu gln arg met leu asp
61/21  SEQ ID NO: 599                             91/31
CAG ATC GAG AGC GCT CTC TAC GCC GAA GAT CCC AAG TTC GCA TCG AGT GTC CGT GGC GGG
gln ile glu ser ala leu tyr ala glu asp pro lys phe ala ser ser val arg gly gly
121/41                                            151/51
GGC TTC CGC GCA CCG ACC GCG CGG CGG CGC CTG CAG GGC GCG GCG TTG TTC ATC ATC GGT
gly phe arg ala pro thr ala arg arg arg leu gln gly ala ala leu phe ile ile gly
181/61                                            211/71
CTG GGG ATG TTG GTT TCC GGC GTG GCG TTC AAA GAG ACC ATG ATC GGA AGT TTC CCG ATA
leu gly met leu val ser gly val ala phe lys glu thr met ile gly ser phe pro ile
241/81                                            271/91
CTC AGC GTT TTC GGT TTT GTC GTG ATG TTC GGT GGT GTG GTG TAT GCC ATC ACC GGT CCT
leu ser val phe gly phe val val met phe gly gly val val tyr ala ile thr gly pro
301/101                                           331/111
CGG TTG TCC GGC AGG ATG GAT CGT GGC GGA TCG GCT GCT GGG GCT TCG CGC CAG CGT CGT
arg leu ser gly arg met asp arg gly gly ser ala ala gly ala ser arg gln arg arg
361/121                                           391/131
ACC AAG GGG GCC GGG GGC TCA TTC ACC AGC CGT ATG GAA GAT C
thr lys gly ala gly gly ser phe thr ser arg met glu asp)

SEQ ID NOS:598-599

FIG. 35A

```
1/1    SEQ ID NO: 600                          31/11
GAC AGT CTG TCG GCA AGG AGG GAC GCA TGC CAC TCT CCG ATC ATG AGC AGC GGA TGC TTG
(asp ser leu ser ala arg arg asp ala cys his ser pro ile met ser ser gly cys leu
61/21     SEQ ID NO: 601                       91/31
ACC AGA TCG AGA GCG CTC TCT ACG CCG AAG ATC CCA AGT TCG CAT CGA GTG TCC GTG GCG
thr arg ser arg ala leu ser thr pro lys ile pro ser ser his arg val ser val ala
121/41                                         151/51
GGG GCT TCC GCG CAC CGA CCG CGC GGC GGC GCC TGC AGG GCG CGG CGT TGT TCA TCA TCG
gly ala ser ala his arg pro arg gly gly ala cys arg ala arg arg cys ser ser ser
181/61                                         211/71
GTC TGG GGA TGT TGG TTT CCG GCG TGG CGT TCA AAG AGA CCA TGA TCG GAA GTT TCC CGA
val trp gly cys trp phe pro ala trp arg ser lys arg pro)OPA(ser glu val ser arg
241/81                                         271/91            SEQ ID NO: 602
TAC TCA GCG TTT TCG GTT TTG TCG TGA TGT TCG GTG GTG TGG TGT ATG CCA TCA CCG GTC
tyr ser ala phe ser val leu ser)OPA(cys ser val val trp cys met pro ser pro val
301/101         SEQ ID NO: 603                 331/111
CTC GGT TGT CCG GCA GGA TGG ATC GTG GCG GAT CGG CTG CTG GGG CTT CGC GCC AGC GTC
leu gly cys pro ala gly trp ile val ala asp arg leu leu gly leu arg ala ser val
361/121                                        391/131
GTA CCA AGG GGG CCG GGG GCT CAT TCA CCA GCC GTA TGG AAG ATC
val pro arg gly pro gly ala his ser pro ala val trp lys ile)
```

SEQ ID NOS:600-603

FIG. 35B

```
1/1    SEQ ID NO: 604                          31/11
ACA GTC TGT CGG CAA GGA GGG ACG CAT GCC ACT CTC CGA TCA TGA GCA GCG GAT GCT TGA
(thr val cys arg gln gly gly thr his ala thr leu arg ser)OPA(ala ala asp ala)OPA
61/21      SEQ ID NO: 605                      91/31           SEQ ID NO: 606
CCA GAT CGA GAG CGC TCT CTA CGC GAA GAT CCA AGT TCG CAT CGA GTG TCC GTG GCG
(pro asp arg glu arg ser leu arg arg arg ser gln val arg ile glu cys pro trp arg
121/41     SEQ ID NO: 607                      151/51
GGG CTT CCG CGC ACC GAC GCG CGG CGG CCT GCA GGG CGC GGC GTT GTT CAT CAT CGG
gly leu pro arg thr asp arg ala ala ala pro ala gly arg gly val val his his arg
181/61                                         211/71
TCT GGG GAT GTT GGT TTC GGC GTG GCG TTC AAA GAG ACC ATG ATC GGA AGT TTC CCG AT
ser gly asp val gly phe arg arg gly val gln arg asp his asp arg lys phe pro asp
241/81                                         271/91
ACT CAG CGT TTT CGG TTT TGT CGT GAT GTT CGG TGG TGT GGT GTA TGC ATC ACC GGT CC
thr gln arg phe arg phe cys arg asp val arg trp cys gly val cys his his arg ser
301/101                                        331/111
TCG GTT GTC CGG CAG GAT GGA TCG TGG CGG ATC GGC TGC TGG GGC TTC GCG CCA GCG TCG
ser val val arg gln asp gly ser trp arg ile gly cys trp gly phe ala pro ala ser
361/121                                        391/131
TAC CAA GGG GGC CGG GGG CTC ATT CAC CAG CCG TAT GGA AGA TC
tyr gln gly gly arg gly leu ile his gln pro tyr gly arg)
```

SEQ ID NOS:604-607

FIG. 35C sequence Rv2169c predicted by Cole et al. (Nature 393:537-544) and
partially containing seq35A

```
1/1   SEQ ID NO: 608                    31/11
atg cca ctc tcc gat cat gag cag cgg atg ctt gac cag atc gag agc gct ctc tac gcc
(Met pro leu ser asp his glu gln arg met leu asp gln ile glu ser ala leu tyr ala
61/21  SEQ ID NO: 609                   91/31
gaa gat ccc aag ttc gca tcg agt gtc cgt ggc ggg ggc ttc cgc gca ccg acc gcg cgg
glu asp pro lys phe ala ser ser val arg gly gly gly phe arg ala pro thr ala arg
121/41                                  151/51
cgg cgc ctg cag ggc gcg gcg ttg ttc atc atc ggt ctg ggg atg ttg gtt tcc ggc gtg
arg arg leu gln gly ala ala leu phe ile ile gly leu gly met leu val ser gly val
181/61                                  211/71
gcg ttc aaa gag acc atg atc gga agt ttc ccg ata ctc agc gtt ttc ggt ttt gtc gtg
ala phe lys glu thr met ile gly ser phe pro ile leu ser val phe gly phe val val
241/81                                  271/91
atg ttc ggt ggt gtg gtg tat gcc atc acc ggt cct cgg ttg tcc ggc agg atg gat cgt
met phe gly gly val val tyr ala ile thr gly pro arg leu ser gly arg met asp arg
301/101                                 331/111
ggc gga tcg gct gct ggg gct tcg cgc cag cgt cgt acc aag ggg gcc ggg ggc tca ttc
gly gly ser ala ala gly ala ser arg gln arg arg thr lys gly ala gly gly ser phe
361/121                                 391/131
acc agc cgt atg gaa gat cgg ttc cgg cgc cgc ttc gac gag taa
thr ser arg met glu asp arg phe arg arg arg phe asp glu)OCH
```

SEQ ID NOS:608-609

FIG. 35D

ORF according to Cole et al. (Nature 393:537-544) and containing Rv2169c

```
1/1   SEQ ID NO: 610                    31/11
tga cag tct gtc ggc aag gag gga cgc atg cca ctc tcc gat cat gag cag cgg atg ctt
OPA(gln ser val gly lys glu gly arg met pro leu ser asp his glu gln arg met leu
61/21  SEQ ID NO: 611                   91/31
gac cag atc gag agc gct ctc tac gcc gaa gat ccc aag ttc gca tcg agt gtc cgt ggc
asp gln ile glu ser ala leu tyr ala glu asp pro lys phe ala ser ser val arg gly
121/41                                  151/51
ggg ggc ttc cgc gca ccg acc gcg cgg cgc ctg cag ggc gcg gcg ttg ttc atc atc
gly gly phe arg ala pro thr ala arg arg leu gln gly ala ala leu phe ile ile
181/61                                  211/71
ggt ctg ggg atg ttg gtt tcc ggc gtg gcg ttc aaa gag acc atg atc gga agt ttc ccg
gly leu gly met leu val ser gly val ala phe lys glu thr met ile gly ser phe pro
241/81                                  271/91
ata ctc agc gtt ttc ggt ttt gtc gtg atg ttc ggt ggt gtg gtg tat gcc atc acc ggt
ile leu ser val phe gly phe val val met phe gly gly val val tyr ala ile thr gly
301/101                                 331/111
cct cgg ttg tcc ggc agg atg gat cgt ggc gga tcg gct gct ggg gct tcg cgc cag cgt
pro arg leu ser gly arg met asp arg gly gly ser ala ala gly ala ser arg gln arg
361/121                                 391/131
cgt acc aag ggg gcc ggg ggc tca ttc acc agc cgt atg gaa gat cgg ttc cgg cgc cgc
arg thr lys gly ala gly gly ser phe thr ser arg met glu asp arg phe arg arg arg
421/141
ttc gac gag taa
phe asp glu)OCH
```

SEQ ID NOS:610-611

FIG. 35E

```
1/1   SEQ ID NO: 612                              31/11
GAC CTG GGA CGA AGA CGA CGG CAG CAG CCG CAA TCA GAT CTA CCC GGT CCT GGT CAA CGT
(asp leu gly arg arg arg arg gln gln pro gln ser asp leu pro gly pro gly gln arg
61/21   SEQ ID NO: 613                            91/31
CAA TGG ACA CCC GAC TAC GGT GCG CCT GCG CGG CTC GAC AAT GCG CGG TTC CTG TTG CCC
gln trp thr pro asp tyr gly ala pro ala arg leu asp asn ala arg phe leu leu pro
121/41                                           151/51
GTG GTC GGA GTG CCA CCC GAC CAG GCC ACC GAC TTC GGC TCC GCT GTT GCA CCA GAA ACG
val val gly val pro pro asp gln ala thr asp phe gly ser ala val ala pro glu thr
181/61                                           211/71
ACG GCG CCG GTC TGG ATC ACC ATG CTG TGG CCG CTG GCC GAC CGG CCC CGG TTG GCC CCC
thr ala pro val trp ile thr met leu trp pro leu ala asp arg pro arg leu ala pro
241/81                                           271/91
GGG GCA CCC GGT GGC ACC GTT CCC GTC CGG CTG GTC GAC GAC GAC CTG GCA AAC TCG CTG
gly ala pro gly gly thr val pro val arg leu val asp asp asp leu ala asn ser leu
301/101                                          331/111
GCC AAC GGC GGC CGG CTG GAC ATC CTC CTG TCG GCG GCC GAG TTC GCC ACC AAC CGG GAA
ala asn gly gly arg leu asp ile leu leu ser ala ala glu phe ala thr asn arg glu
361/121                                          391/131
GTC GAC CCC GAC GGC GCC GTC GGC CGA GCG CTG TGC CTG GCC ATC GAC CCA GAT C
val asp pro asp gly ala val gly arg ala leu cys leu ala ile asp pro asp)
```

SEQ ID NOS:612-613

FIG. 36A

```
1/1   SEQ ID NO: 614                              31/11
ACC TGG GAC GAA GAC GAC GGC AGC AGC CGC AAT CAG ATC TAC CCG GTC CTG GTC AAC GTC
(thr trp asp glu asp asp gly ser ser arg asn gln ile tyr pro val leu val asn val
61/21   SEQ ID NO: 615                            91/31
AAT GGA CAC CCG ACT ACG GTG CGC CTG CGC GGC TCG ACA ATG CGC GGT TCC TGT TGC CCG
asn gly his pro thr thr val arg leu arg gly ser thr met arg gly ser cys cys pro
121/41                                           151/51
TGG TCG GAG TGC CAC CCG ACC AGG CCA CCG ACT TCG GCT CCG CTG TTG CAC CAG AAA CGA
trp ser glu cys his pro thr arg pro pro thr ser ala pro leu leu his gln lys arg
181/61                                           211/71
CGG CGC CGG TCT GGA TCA CCA TGC TGT GGC CGC TGG CCG ACC GGC CCC GGT TGG CCC CCG
arg arg arg ser gly ser pro cys cys gly arg trp pro thr gly pro gly trp pro pro
241/81                                           271/91
GGG CAC CCG GTG GCA CCG TTC CCG TCC GGC TGG TCG ACG ACG ACC TGG CAA ACT CGC TGG
gly his pro val ala pro phe pro ser gly trp ser thr thr thr trp gln thr arg trp
301/101                                          331/111
CCA ACG GCG GCC GGC TGG ACA TCC TCC TGT CGG CGG CCG AGT TCG CCA CCA ACC GGG AAG
pro thr ala ala gly trp thr ser ser cys arg arg pro ser ser pro pro thr gly lys
361/121                                          391/131
TCG ACC CCG ACG GCG CCG TCG GCC GAG CGC TGT GCC TGG CCA TCG ACC CAG ATC
ser thr pro thr ala pro ser ala glu arg cys ala trp pro ser thr gln ile)
```

SEQ ID NOS:614-615

FIG. 36B

1/1 SEQ ID NO: 616                          31/11
CCT GGG ACG AAG ACG ACG GCA GCA GCC GCA ATC AGA TCT ACC CGG TCC TGG TCA ACG TCA
(pro gly thr lys thr thr ala ala ala ala ile arg ser thr arg ser trp ser thr ser
61/21 SEQ ID NO: 617                        91/31
ATG GAC ACC CGA CTA CGG TGC GCC TGC GCG GCT CGA CAA TGC GCG GTT CCT GTT GCC CGT
met asp thr arg leu arg cys ala cys ala ala arg gln cys ala val pro val ala arg
121/41                                      151/51
GGT CGG AGT GCC ACC CGA CCA GGC CAC CGA CTT CGG CTC CGC TGT TGC ACC AGA AAC GAC
gly arg ser ala thr arg pro gly his arg leu arg leu arg cys cys thr arg asn asp
181/61                                      211/71
GGC GCC GGT CTG GAT CAC CAT GCT GTG GCC GCT GGC CGA CCG GCC CCG GTT GGC CCC CGG
gly ala gly leu asp his his ala val ala ala gly arg pro ala pro val gly pro arg
241/81                                      271/91
GGC ACC CGG TGG CAC CGT TCC CGT CCG GCT GGT CGA CGA CGA CCT GGC AAA CTC GCT GGC
gly thr arg trp his arg ser arg pro ala gly arg arg arg pro gly lys leu ala gly
301/101                                     331/111
CAA CGG CGG CCG GCT GGA CAT CCT CCT GTC GGC GGC CGA GTT CGC CAC CAA CCG GGA AGT
gln arg arg pro ala gly his pro pro val gly gly arg val arg his gln pro gly ser
361/121                                     391/131
CGA CCC CGA CGG CGC CGT CGG CCG AGC GCT GTG CCT GGC CAT CGA CCC AGA TC
arg pro arg arg arg arg arg pro ser ala val pro gly his arg pro arg)

SEQ ID NOS:616-617

FIG. 36C

Coding sequence Rv3909 predicted by Cole et al., 1998 (Nature 393
537-544) containing Seq 36A 1/1 SEQ ID NO: 618                          31/11
GTG ACC GCA CTG CAA CTC GGC TGG GCC GCT TTG GCG CGC GTC ACC TCA GCG ATC GGC GTC
(met thr ala leu gln leu gly trp ala ala leu ala arg val thr ser ala ile gly val
61/21 SEQ ID NO: 619                        91/31
GTG GCC GGC CTC GGG ATG GCG CTC ACG GTA CCG TCG GCG GCA CCG CAC GCG CTC GCA GGC
val ala gly leu gly met ala leu thr val pro ser ala ala pro his ala leu ala gly
121/41                                      151/51
GAG CCC AGC CCG ACG CCT TTT GTC CAG GTC CGC ATC GAT CAG GTG ACC CCG GAC GTG GTG
glu pro ser pro thr pro phe val gln val arg ile asp gln val thr pro asp val val
181/61                                      211/71
ACC ACT TCC AGC GAA CCC CAT GTC ACC GTC AGC GGA ACG GTG ACC AAT ACC GGT GAC CGC
thr thr ser ser glu pro his val thr val ser gly thr val thr asn thr gly asp arg
241/81                                      271/91
CCA GTC CGC GAT GTG ATG GTC CGG CTT GAG CAC GCC GCC GCG GTC ACG TCG TCA ACG GCG
pro val arg asp val met val arg leu glu his ala ala ala val thr ser ser thr ala
301/101                                     331/111
TTA CGC ACC TCG CTC GAC GGC GGC ACC GAC CAG TAC CAG CCG GCC GCG GAC TTC CTC ACG
leu arg thr ser leu asp gly gly thr asp gln tyr gln pro ala ala asp phe leu thr

SEQ ID NOS:618-619

FIG. 36D

```
361/121                                      391/131
GTC GCC CCC GAA CTA GAC CGC GGG CAA GAG GCC GGC TTT ACC CTC TCG GCC CCG CTG CGC
val ala pro glu leu asp arg gly gln glu ala gly phe thr leu ser ala pro leu arg
421/141                                      451/151
TCG CTG ACC AGG CCG TCG TTG GCC GTC AAC CAG CCC GGG ATC TAC CCG GTC CTG GTC AAC
ser leu thr arg pro ser leu ala val asn gln pro gly ile tyr pro val leu val asn
481/161                                      511/171
GTC AAT GGG ACA CCC GAC TAC GGT GCG CCT GCG CGG CTC GAC AAT GCG CGG TTC CTG TTG
val asn gly thr pro asp tyr gly ala pro ala arg leu asp asn ala arg phe leu leu
541/181                                      571/191
CCC GTG GTC GGA GTG CCA CCC GAC CAG GCC ACC GAC TTC GGC TCC GCT GTT GCA CCA GAA
pro val gly val pro pro asp gln ala thr asp phe gly ser ala val ala pro glu
601/201                                      631/211
ACG ACG GCG CCG GTC TGG ATC ACC ATG CTG TGG CCG CTG GCC GAC CGG CCC CGG TTG GCC
thr thr ala pro val trp ile thr met leu trp pro leu ala asp arg pro arg leu ala
661/221                                      691/231
CCC GGG GCA CCC GGT GGC ACC GTT CCC GTC CGG CTG GTC GAC GAC GAC CTG GCA AAC TCG
pro gly ala pro gly gly thr val pro val arg leu val asp asp asp leu ala asn ser
721/241                                      751/251
CTG GCC AAC GGC GGC CGG CTG GAC ATC CTC CTG TCG GCG GCC GAG TTC GCC ACC AAC CGG
leu ala asn gly gly arg leu asp ile leu leu ser ala ala glu phe ala thr asn arg
781/261                                      811/271
GAA GTC GAC CCC GAC GGC GCC GTC GGC CGA GCG CTG TGC CTG GCC ATC GAC CCA GAT CTA
glu val asp pro asp gly ala val gly arg ala leu cys leu ala ile asp pro asp leu
841/281                                      871/291
CTC ATC ACC GTC AAT GCG ATG ACC GGC GGC TAC GTC GTG TCC GAC TCG CCC GAC GGG GCC
leu ile thr val asn ala met thr gly gly tyr val val ser asp ser pro asp gly ala
901/301                                      931/311
GCT CAA CTA CCG GGC ACC CCG ACC CAC CCG GGC ACC GGC CAG GCC GCC GCA TCC AGC TGG
ala gln leu pro gly thr pro thr his pro gly thr gly gln ala ala ala ser ser trp
961/321                                      991/331
CTG GAT CGA TTG CGG ACG CTA GTC CAC CGG ACA TGC GTG ACG CCG CTG CCT TTT GCC CAA
leu asp arg leu arg thr leu val his arg thr cys val thr pro leu pro phe ala gln
1021/341                                     1051/351
GCC GAC CTG GAT GCT TTG CAG CGG GTT AAT GAT CCG AGG CTG AGC GCG ATC GCA ACC ATC
ala asp leu asp ala leu gln arg val asn asp pro arg leu ser ala ile ala thr ile
1081/361                                     1111/371
AGC CCC GCC GAC ATC GTC GAC CGC ATC CTG GAT GTC AGC TCC ACC CGC GGC GCA ACC GTG
ser pro ala asp ile val asp arg ile leu asp val ser ser thr arg gly ala thr val
1141/381                                     1171/391
CTG CCC GAC GGC CCG TTG ACC GGC CGG GCG ATC AAC TTG CTC AGC ACC CAC GGC AAC ACG
leu pro asp gly pro leu thr gly arg ala ile asn leu leu ser thr his gly asn thr
1201/401                                     1231/411
GTT GCC GTC GCG GCC GCC GAT TTT AGC CCC GAG GAA CAG CAG GGT TCG TCC CAG ATC GGC
val ala val ala ala ala asp phe ser pro glu glu gln gln gly ser ser gln ile gly
1261/421                                     1291/431
TCC GCG CTC TTA CCC GCT ACC GCG CCC CGG CGG TTG TCC CCG CGG GTG GTA GCG GCG CCG
ser ala leu leu pro ala thr ala pro arg arg leu ser pro arg val val ala ala pro
1321/441                                     1351/451
TTT GAT CCC GCG GTC GGG GCC GCG CTG GCC GCC GCG GGA ACA AAC CCG ACC GTT CCT ACC
phe asp pro ala val gly ala ala leu ala ala ala gly thr asn pro thr val pro thr
1381/461                                     1411/471
TAT CTA GAT CCC TCG TTG TTC GTT CGG ATC GCG CAT GAA TCG ATC ACC GCG CGC CGC CAG
tyr leu asp pro ser leu phe val arg ile ala his glu ser ile thr ala arg arg gln
```

SEQ ID NOS:618-619(continued 1)

FIG. 36D (continued 1)

```
1441/481                              1471/491
GAC GCC TTG GGC GCA ATG CTG TGG CGC AGC TTG GAG CCG AAT GCC GCG CCC CGT ACC CAA
asp ala leu gly ala met leu trp arg ser leu glu pro asn ala ala pro arg thr gln
1501/501                              1531/511
ATC CTG GTG CCG CCG GCG TCG TGG AGC CTG GCC AGC GAC GAC GCG CAG GTC ATC CTG ACC
ile leu val pro pro ala ser trp ser leu ala ser asp asp ala gln val ile leu thr
1561/521                              1591/531
GCG CTG GCC ACC GCC ATC CGG TCT GGC CTG GCC GTG CCG CGA CCA CTA CCG GCG GTG ATC
ala leu ala thr ala ile arg ser gly leu ala val pro arg pro leu pro ala val ile
1621/541                              1651/551
GCT GAC GCC GCG GCC CGC ACC GAG CCA CCG GAA CCC CCG GGC GCT TAC AGC GCC GCT CGC
ala asp ala ala ala arg thr glu pro pro glu pro pro gly ala tyr ser ala ala arg
1681/561                              1711/571
GGC CGG TTC AAT GAC GAC ATC ACC ACG CAG ATC GGC GGG CAG GTT GCC CGG CTA TGG AAG
gly arg phe asn asp asp ile thr thr gln ile gly gly gln val ala arg leu trp lys
1741/581                              1771/591
CTG ACC TCG GCG TTG ACC ATC GAT GAC CGC ACC GGG CTG ACC GGC GTG CAG TAC ACC GCA
leu thr ser ala leu thr ile asp asp arg thr gly leu thr gly val gln tyr thr ala
1801/601                              1831/611
CCA CTA CGC GAG GAC ATG TTG CGC GCG CTG AGC CAA TCG CTA CCA CCC GAT ACC CGC AAC
pro leu arg glu asp met leu arg ala leu ser gln ser leu pro pro asp thr arg asn
1861/621                              1891/631
GGG CTG GCC CAG CAG CGG CTG GCC GTC GTT GGA AAG ACG ATC GAC GAT CTT TTC GGC GCG
gly leu ala gln gln arg leu ala val val gly lys thr ile asp asp leu phe gly ala
1921/641                              1951/651
GTG ACC ATC GTC AAC CCG GGC GGC TCC TAC ACT CTG GCC ACC GAG CAC AGT CCG CTG CCG
val thr ile val asn pro gly gly ser tyr thr leu ala thr glu his ser pro leu pro
1981/661                              2011/671
TTG GCG CTG CAT AAT GGC CTC GCC GTG CCA ATC CGG GTC CGG CTA CAG GTC GAT GCT CCG
leu ala leu his asn gly leu ala val pro ile arg val arg leu gln val asp ala pro
2041/681                              2071/691
CCC GGG ATG ACG GTG GCC GAT GTC GGT CAG ATC GAG CTA CCG CCC GGG TAC CTG CCG CTA
pro gly met thr val ala asp val gly gln ile glu leu pro pro gly tyr leu pro leu
2101/701                              2131/711
CGA GTA CCA ATC GAG GTG AAC TTC ACA CAG CGG GTT GCC GTC GAC GTG TCG CTG CGG ACC
arg val pro ile glu val asn phe thr gln arg val ala val asp val ser leu arg thr
2161/721                              2191/731
CCC GAC GGC GTC GCG CTG GGT GAA CCG GTG CGG TTG TCG GTG CAC TCC AAC GCC TAC GGC
pro asp gly val ala leu gly glu pro val arg leu ser val his ser asn ala tyr gly
2221/741                              2251/751
AAG GTG TTG TTC GCG ATC ACG CTA TCC GCT GCG GCC GTG CTG GTA ACG CTG GCG GGC CGG
lys val leu phe ala ile thr leu ser ala ala ala val leu val thr leu ala gly arg
2281/761                              2311/771
CGC CTT TGG CAC CGG TTC CGT GGC CAG CCT GAT CGC GCC GAC CTG GAT CGC CCC GAC CTG
arg leu trp his arg phe arg gly gln pro asp arg ala asp leu asp arg pro asp leu
2341/781                              2371/791
CCT ACC GGC AAA CAC GCC CCG CAG CGC CGT GCC GTA GCC AGT CGG GAT GAC GAA AAG CAC
pro thr gly lys his ala pro gln arg arg ala val ala ser arg asp asp glu lys his
2401/801
CGG GTA TGA
arg val)OPA
```

SEQ ID NOS:618-619 (continued 2)

FIG. 36D (continued 2)

ORF according to Cole et al., 1998 (Nature 393 537-544) and containing Rv 3909.

```
1/1   SEQ ID NO: 620                       31/11
TGA CTC AGC ACC GGG TCA GCA CAA CGG TCC CGG GCC GGG GCC GTG ACC GCA CTG CAA CTC
OPA(leu ser thr gly ser ala gln arg ser arg ala gly ala val thr ala leu gln leu
61/21   SEQ ID NO: 621                     91/31
GGC TGG GCC GCT TTG GCG CGC GTC ACC TCA GCG ATC GGC GTC GTG GCC GGC CTC GGG ATG
gly trp ala ala leu ala arg val thr ser ala ile gly val val ala gly leu gly met
121/41                                    151/51
GCG CTC ACG GTA CCG TCG GCG GCA CCG CAC GCG CTC GCA GGC GAG CCC AGC CCG ACG CCT
ala leu thr val pro ser ala ala pro his ala leu ala gly glu pro ser pro thr pro
181/61                                    211/71
TTT GTC CAG GTC CGC ATC GAT CAG GTG ACC CCG GAC GTG GTG ACC ACT TCC AGC GAA CCC
phe val gln val arg ile asp gln val thr pro asp val val thr thr ser ser glu pro
241/81                                    271/91
CAT GTC ACC GTC AGC GGA ACG GTG ACC AAT ACC GGT GAC CGC CCA GTC CGC GAT GTG ATG
his val thr val ser gly thr val thr asn thr gly asp arg pro val arg asp val met
301/101                                   331/111
GTC CGG CTT GAG CAC GCC GCC GCG GTC ACG TCG TCA ACG GCG TTA CGC ACC TCG CTC GAC
val arg leu glu his ala ala ala val thr ser ser thr ala leu arg thr ser leu asp
361/121                                   391/131
GGC GGC ACC GAC CAG TAC CAG CCG GCC GCG GAC TTC CTC ACG GTC GCC CCC GAA CTA GAC
gly gly thr asp gln tyr gln pro ala ala asp phe leu thr val ala pro glu leu asp
421/141                                   451/151
CGC GGG CAA GAG GCC GGC TTT ACC CTC TCG GCC CCG CTG CGC TCG CTG ACC AGG CCG TCG
arg gly gln glu ala gly phe thr leu ser ala pro leu arg ser leu thr arg pro ser
481/161                                   511/171
TTG GCC GTC AAC CAG CCC GGG ATC TAC CCG GTC CTG GTC AAC GTC AAT GGG ACA CCC GAC
leu ala val asn gln pro gly ile tyr pro val leu val asn val asn gly thr pro asp
541/181                                   571/191
TAC GGT GCG CCT GCG CGG CTC GAC AAT GCG CGG TTC CTG TTG CCC GTG GTC GGA GTG CCA
tyr gly ala pro ala arg leu asp asn ala arg phe leu leu pro val val gly val pro
601/201                                   631/211
CCC GAC CAG GCC ACC GAC TTC GGC TCC GCT GTT GCA CCA GAA ACG ACG GCG CCG GTC TGG
pro asp gln ala thr asp phe gly ser ala val ala pro glu thr thr ala pro val trp
661/221                                   691/231
ATC ACC ATG CTG TGG CCG CTG GCC GAC CGG CCC CGG TTG GCC CCC GGG GCA CCC GGT GGC
ile thr met leu trp pro leu ala asp arg pro arg leu ala pro gly ala pro gly gly
721/241                                   751/251
ACC GTT CCC GTC CGG CTG GTC GAC GAC GAC CTG GCA AAC TCG CTG GCC AAC GGC GGC CGG
thr val pro val arg leu val asp asp asp leu ala asn ser leu ala asn gly gly arg
781/261                                   811/271
CTG GAC ATC CTC CTG TCG GCG GCC GAG TTC GCC ACC AAC CGG GAA GTC GAC CCC GAC GGC
leu asp ile leu leu ser ala ala glu phe ala thr asn arg glu val asp pro asp gly
841/281                                   871/291
GCC GTC GGC CGA GCG CTG TGC CTG GCC ATC GAC CCA GAT CTA CTC ATC ACC GTC AAT GCG
ala val gly arg ala leu cys leu ala ile asp pro asp leu leu ile thr val asn ala
901/301                                   931/311
ATG ACC GGC GGC TAC GTC GTG TCC GAC TCG CCC GAC GGG GCC GCT CAA CTA CCG GGC ACC
met thr gly gly tyr val val ser asp ser pro asp gly ala ala gln leu pro gly thr
961/321                                   991/331
CCG ACC CAC CCG GGC ACC GGC CAG GCC GCC GCA TCC AGC TGG CTG GAT CGA TTG CGG ACG
pro thr his pro gly thr gly gln ala ala ala ser ser trp leu asp arg leu arg thr
```

SEQ ID NOS:620-621

FIG. 36E

```
1021/341                                        1051/351
CTA GTC CAC CGG ACA TGC GTG ACG CCG CTG         CCT TTT GCC CAA GCC GAC CTG GAT GCT TTG
leu val his arg thr cys val thr pro leu         pro phe ala gln ala asp leu asp ala leu
1081/361                                        1111/371
CAG CGG GTT AAT GAT CCG AGG CTG AGC GCG         ATC GCA ACC ATC AGC CCC GCC GAC ATC GTC
gln arg val asn asp pro arg leu ser ala         ile ala thr ile ser pro ala asp ile val
1141/381                                        1171/391
GAC CGC ATC CTG GAT GTC AGC TCC ACC CGC         GGC GCA ACC GTG CTG CCC GAC GGC CCG TTG
asp arg ile leu asp val ser ser thr arg         gly ala thr val leu pro asp gly pro leu
1201/401                                        1231/411
ACC GGC CGG GCG ATC AAC TTG CTC AGC ACC         CAC GGC AAC ACG GTT GCC GTC GCG GCC GCC
thr gly arg ala ile asn leu leu ser thr         his gly asn thr val ala val ala ala ala
1261/421                                        1291/431
GAT TTT AGC CCC GAG GAA CAG CAG GGT TCG         TCC CAG ATC GGC TCC GCG CTC TTA CCC GCT
asp phe ser pro glu glu gln gln gly ser         ser gln ile gly ser ala leu leu pro ala
1321/441                                        1351/451
ACC GCG CCC CGG CGG TTG TCC CCG CGG GTG         GTA GCG GCG CCG TTT GAT CCC GCG GTC GGG
thr ala pro arg arg leu ser pro arg val         val ala ala pro phe asp pro ala val gly
1381/461                                        1411/471
GCC GCG CTG GCC GCC GCG GGA ACA AAC CCG         ACC GTT CCT ACC TAT CTA GAT CCC TCG TTG
ala ala leu ala ala ala gly thr asn pro         thr val pro thr tyr leu asp pro ser leu
1441/481                                        1471/491
TTC GTT CGG ATC GCG CAT GAA TCG ATC ACC         GCG CGC CGC CAG GAC GCC TTG GGC GCA ATG
phe val arg ile ala his glu ser ile thr         ala arg arg gln asp ala leu gly ala met
1501/501                                        1531/511
CTG TGG CGC AGC TTG GAG CCG AAT GCC GCG         CCC CGT ACC CAA ATC CTG GTG CCG CCG GCG
leu trp arg ser leu glu pro asn ala ala         pro arg thr gln ile leu val pro pro ala
1561/521                                        1591/531
TCG TGG AGC CTG GCC AGC GAC GAC GCG CAG         GTC ATC CTG ACC GCG CTG GCC ACC GCC ATC
ser trp ser leu ala ser asp asp ala gln         val ile leu thr ala leu ala thr ala ile
1621/541                                        1651/551
CGG TCT GGC CTG GCC GTG CCG CGA CCA CTA         CCG GCG GTG ATC GCT GAC GCC GCG GCC CGC
arg ser gly leu ala val pro arg pro leu         pro ala val ile ala asp ala ala ala arg
1681/561                                        1711/571
ACC GAG CCA CCG GAA CCC CCG GGC GCT TAC         AGC GCC GCT CGC GGC CGG TTC AAT GAC GAC
thr glu pro pro glu pro pro gly ala tyr         ser ala ala arg gly arg phe asn asp asp
1741/581                                        1771/591
ATC ACC ACG CAG ATC GGC GGG CAG GTT GCC         CGG CTA TGG AAG CTG ACC TCG GCG TTG ACC
ile thr thr gln ile gly gly gln val ala         arg leu trp lys leu thr ser ala leu thr
1801/601                                        1831/611
ATC GAT GAC CGC ACC GGG CTG ACC GGC GTG         CAG TAC ACC GCA CCA CTA CGC GAG GAC ATG
ile asp asp arg thr gly leu thr gly val         gln tyr thr ala pro leu arg glu asp met
1861/621                                        1891/631
TTG CGC GCG CTG AGC CAA TCG CTA CCA CCC         GAT ACC CGC AAC GGG CTG GCC CAG CAG CGG
leu arg ala leu ser gln ser leu pro pro         asp thr arg asn gly leu ala gln gln arg
1921/641                                        1951/651
CTG GCC GTC GTT GGA AAG ACG ATC GAC GAT         CTT TTC GGC GCG GTG ACC ATC GTC AAC CCG
leu ala val val gly lys thr ile asp asp         leu phe gly ala val thr ile val asn pro
1981/661                                        2011/671
GGC GGC TCC TAC ACT CTG GCC ACC GAG CAC         AGT CCG CTG CCG TTG GCG CTG CAT AAT GGC
gly gly ser tyr thr leu ala thr glu his         ser pro leu pro leu ala leu his asn gly
```

SEQ ID NOS: 620-621 (continued 1)

FIG. 36E (continued 1)

```
2041/681                                    2071/691
CTC GCC GTG CCA ATC CGG GTC CGG CTA CAG GTC GAT GCT CCG CCC GGG ATG ACG GTG GCC
leu ala val pro ile arg val arg leu gln val asp ala pro pro gly met thr val ala
2101/701                                    2131/711
GAT GTC GGT CAG ATC GAG CTA CCG CCC GGG TAC CTG CCG CTA CGA GTA CCA ATC GAG GTG
asp val gly gln ile glu leu pro pro gly tyr leu pro leu arg val pro ile glu val
2161/721                                    2191/731
AAC TTC ACA CAG CGG GTT GCC GTC GAC GTG TCG CTG CGG ACC CCC GAC GGC GTC GCG CTG
asn phe thr gln arg val ala val asp val ser leu arg thr pro asp gly val ala leu
2221/741                                    2251/751
GGT GAA CCG GTG CGG TTG TCG GTG CAC TCC AAC GCC TAC GGC AAG GTG TTG TTC GCG ATC
gly glu pro val arg leu ser val his ser asn ala tyr gly lys val leu phe ala ile
2281/761                                    2311/771
ACG CTA TCC GCT GCG GCC GTG CTG GTA ACG CTG GCG GGC CGG CGC CTT TGG CAC CGG TTC
thr leu ser ala ala ala val leu val thr leu ala gly arg arg leu trp his arg phe
2341/781                                    2371/791
CGT GGC CAG CCT GAT CGC GCC GAC CTG GAT CGC CCC GAC CTG CCT ACC GGC AAA CAC GCC
arg gly gln pro asp arg ala asp leu asp arg pro asp leu pro thr gly lys his ala
2401/801                                    2431/811
CCG CAG CGC CGT GCC GTA GCC AGT CGG GAT GAC GAA AAG CAC CGG GTA TGA
pro gln arg arg ala val ala ser arg asp asp glu lys his arg val)OPA
```

SEQ ID NOS: 620-621 (continued 2)

FIG. 36E (continued 2)

```
1/1   SEQ ID NO: 622                       31/11
ATC CGC GCG TTG GCG TCG CAT CCG AAC ATC GTC GGA GTC AAG GAC GCC AAA GCC GAC CTG
(ile arg ala leu ala ser his pro asn ile val gly val lys asp ala lys ala asp leu
61/21  SEQ ID NO: 623                      91/31
CAC AGC GGC GCC CAA ATC ATG GCC GAC ACC GGA CTG GCC TAC TAT TCC GGC GAC GAC GCG
his ser gly ala gln ile met ala asp thr gly leu ala tyr tyr ser gly asp asp ala
121/41                                     151/51
CTC AAC CTG CCC TGG CTG GCC ATG GGC GCC ACG GGC TTC ATC AGC GTG ATT GCC CAC CTG
leu asn leu pro trp leu ala met gly ala thr gly phe ile ser val ile ala his leu
181/61                                     211/71
GCA GCC GGG CAG CTT CGA GAG TTG TTG TCC GCC TTC GGT TCT GGG GAT ATC GCC ACC GCC
ala ala gly gln leu arg glu leu leu ser ala phe gly ser gly asp ile ala thr ala
241/81
CGC AAG ATC
arg lys ile)
```

SEQ ID NOS:622-623

FIG. 37A

```
1/1   ─SEQ ID NO: 624                         31/11
GAT CCG CGC GTT GGC GTC GCA TCC GAA CAT CGT CGG AGT CAA GGA CGC CAA AGC CGA CCT
(asp pro arg val gly val ala ser glu his arg arg ser gln gly arg gln ser arg pro
61/21  ─SEQ ID NO: 625                        91/31
GCA CAG CGG CGC CCA AAT CAT GGC CGA CAC CGG ACT GGC CTA CTA TTC CGG CGA CGA CGC
ala gln arg arg pro asn his gly arg his arg thr gly leu leu phe arg arg arg arg
121/41                                        151/51
GCT CAA CCT GCC CTG GCT GGC CAT GGG CGC CAC GGG CTT CAT CAG CGT GAT TGC CCA CCT
ala gln pro ala leu ala gly his gly arg his gly leu his gln arg asp cys pro pro
181/61                                        211/71
GGC AGC CGG GCA GCT TCG AGA GTT GTT GTC CGC CTT CGG TTC TGG GGA TAT CGC CAC CGC
gly ser arg ala ala ser arg val val val arg leu arg phe trp gly tyr arg his arg
241/81
CCG CAA GAT C
pro gln asp)
```

SEQ ID NOS:624-625

FIG. 37B

```
1/1   ─SEQ ID NO: 626                         31/11
TCC GCG CGT TGG CGT CGC ATC CGA ACA TCG TCG GAG TCA AGG ACG CCA AAG CCG ACC TGC
(ser ala arg trp arg arg ile arg thr ser ser glu ser arg thr pro lys pro thr cys
61/21  ─SEQ ID NO: 627                        91/31
ACA GCG GCG CCC AAA TCA TGG CCG ACA CCG GAC TGG CCT ACT ATT CCG GCG ACG ACG CGC
thr ala ala pro lys ser trp pro thr pro asp trp pro thr ile pro ala thr thr arg
121/41                                        151/51
TCA ACC TGC CCT GGC TGG CCA TGG GCG CCA CGG GCT TCA TCA GCG TGA TTG CCC ACC TGG
ser thr cys pro gly trp pro trp ala pro arg ala ser ser ala)OPA(leu pro thr trp
181/61                                        211/71  SEQ ID NO: 628
CAG CCG GGC AGC TTC GAG AGT TGT TGT CCG CCT TCG GTT CTG GGA TAT CGC CAC CGC CC
gln pro gly ser phe glu ser cys cys pro pro ser val leu gly ile ser pro pro pro
241/81
GCA AGA TC
ala arg)
```

SEQ ID NOS:626-628

FIG. 37C

Coding sequence Rv2753c predicted by Cole et al., 1998 (Nature 393 537-544) containing Seq 37A 1/1 —SEQ ID NO: 629                                31/11
GTG ACC ACC GTC GGA TTC GAC GTC GCA GCG CGC CTA GGA ACC CTG CTG ACC GCG ATG GTG
(val thr thr val gly phe asp val ala ala arg leu gly thr leu leu thr ala met val
61/21 —SEQ ID NO: 630                              91/31
ACA CCG TTT AGC GGC GAT GGC TCC CTG GAC ACC GCC ACC GCG GCG CGG CTG GCC AAC CAC
thr pro phe ser gly asp gly ser leu asp thr ala thr ala ala arg leu ala asn his
121/41                                             151/51
CTG GTC GAT CAG GGG TGC GAC GGT CTG GTG GTC TCG GGC ACC ACC GGC GAG TCG CCG ACC
leu val asp gln gly cys asp gly leu val val ser gly thr thr gly glu ser pro thr
181/61                                             211/71
ACC ACC GAC GGG GAG AAA ATC GAG CTG CTG CGG GCC GTC TTG GAA GCG GTG GGG GAC CGG
thr thr asp gly glu lys ile glu leu leu arg ala val leu glu ala val gly asp arg
241/81                                             271/91
GCC CGT GTT ATC GCC GGT GCC GGC ACC TAT GAC ACC GCG CAC AGC ATC CGG CTG GCC AAG
ala arg val ile ala gly ala gly thr tyr asp thr ala his ser ile arg leu ala lys
301/101                                            331/111
GCT TGT GCG GCC GAG GGT GCG CAC GGG CTG CTG GTG GTC ACG CCC TAC TAT TCC AAG CCG
ala cys ala ala glu gly ala his gly leu leu val val thr pro tyr tyr ser lys pro
361/121                                            391/131
CCG CAG CGG GGG CTG CAA GCC CAT TTC ACC GCC GTC GCC GAC GCG ACC GAG CTG CCG ATG
pro gln arg gly leu gln ala his phe thr ala val ala asp ala thr glu leu pro met
421/141                                            451/151
CTG CTC TAT GAC ATC CCG GGG CGG TCG GCG GTG CCG ATC GAG CCC GAC ACG ATC CGC GCG
leu leu tyr asp ile pro gly arg ser ala val pro ile glu pro asp thr ile arg ala
481/161                                            511/171
TTG GCG TCG CAT CCG AAC ATC GTC GGA GTC AAG GAC GCC AAA GCC GAC CTG CAC AGC GGC
leu ala ser his pro asn ile val gly val lys asp ala lys ala asp leu his ser gly
541/181                                            571/191
GCC CAA ATC ATG GCC GAC ACC GGA CTG GCC TAC TAT TCC GGC GAC GAC GCG CTC AAC CTG
ala gln ile met ala asp thr gly leu ala tyr tyr ser gly asp asp ala leu asn leu
601/201                                            631/211
CCC TGG CTG GCC ATG GGC GCC ACG GGC TTC ATC AGC GTG ATT GCC CAC CTG GCA GCC GGG
pro trp leu ala met gly ala thr gly phe ile ser val ile ala his leu ala ala gly
661/221                                            691/231
CAG CTT CGA GAG TTG TTG TCC GCC TTC GGT TCT GGG GAT ATC GCC ACC GCC CGC AAG ATC
gln leu arg glu leu leu ser ala phe gly ser gly asp ile ala thr ala arg lys ile
721/241                                            751/251
AAC ATT GCG GTC GCC CCG CTG TGC AAC GCG ATG AGC CGC CTG GGT GGG GTG ACG TTG TCC
asn ile ala val ala pro leu cys asn ala met ser arg leu gly gly val thr leu ser
781/261                                            811/271
AAG GCG GGC TTG CGG CTG CAG GGC ATC GAC GTC GGT GAT CCC CGG CTG CCC CAG GTG GCC
lys ala gly leu arg leu gln gly ile asp val gly asp pro arg leu pro gln val ala
841/281                                            871/291
GCG ACA CCG GAG CAG ATC GAC GCG TTG GCC GCC GAC ATG CGC GCG GCC TCG GTG CTT CGG
ala thr pro glu gln ile asp ala leu ala ala asp met arg ala ala ser val leu arg)

901/301
TGA
OPA

SEQ ID NOS:629-630

FIG. 37D

ORF according to Cole et al., 1998 (Nature 393 537-544) containing Rv2753c

1/1 — SEQ ID NO: 631                           31/11
TAA GGT GAG CGC CGT GGC CGA GAC CGC GCC GCT GCG CGT GCA ACT GAT CGC CAA GAC CGA
OCH(gly glu arg arg gly arg asp arg ala ala ala arg ala thr asp arg gln asp arg
61/21 — SEQ ID NO: 632                          91/31
CTT CTT GGC CCC ACC CGA CGT GCC CTG GAC CAC CGA CGC CGA CGG CGG ACC CGC GCT GGT
leu leu gly pro thr arg arg ala leu asp his arg arg arg arg arg thr arg ala gly
121/41                                         151/51
CGA GTT CGC CGG CCG GGC CTG CTA TCA GAG CTG GTC CAA GCC CAA TCC CAA GAC CGC CAC
arg val arg arg pro gly leu leu ser glu leu val gln ala gln ser gln asp arg his
181/61                                         211/71
CAA CGC CGG CTA CCT CCG GCA CAT CAT CGA CGT CGG ACA TTT CTC GGT GCT AGA GCA TGC
gln arg arg leu pro pro ala his his arg arg arg thr phe leu gly ala arg ala cys
241/81                                         271/91
CAG CGT GTC GTT CTA CAT CAC CGG GAT CTC GCG ATC GTG CAC CCA CGA GCT GAT CCG CCA
gln arg val val leu his his arg asp leu ala ile val his pro arg ala asp pro pro
301/101                                        331/111
CCG GCA TTT CTC CTA CTC GCA GCT CTC CCA GCG CTA CGT ACC CGA GAA GGA CTC GCG GGT
pro ala phe leu leu leu ala ala leu pro ala leu arg thr arg glu gly leu ala gly
361/121                                        391/131
CGT CGT GCC GCC CGG CAT GGA GGA CGA CGC CGA CCT GCG CCA CAT CCT GAC CGA GGC CGC
arg arg ala ala arg his gly gly arg arg arg pro ala pro his pro asp arg gly arg
421/141                                        451/151
CGA CGC CGC CCG CGC CAC CTA CAG CGA GCT GCT GGC CAA GCT GGA AGC CAA GTT CGC CGA
arg arg arg pro arg his leu gln arg ala ala gly gln ala gly ser gln val arg arg
481/161                                        511/171
CCA ACC CAA CGC GAT CCT GCG CCG CAA GCA GGC CCG CCA AGC CGC CCG CGC GGT GCT GCC
pro thr gln arg asp pro ala pro gln ala gly pro pro ser arg pro arg gly ala ala
541/181 571/191
CAA CGC CAC CGA AAC CCG CAT CGT GGT GAC CGG CAA CTA CCG GGC CTG GCG GCA CTT CAT
gln arg his arg asn pro his arg gly asp arg gln leu pro gly leu ala ala leu his
601/201 631/211
CGC AAT GCG GGC CAG CGA GCA CGC CGA CGT GGA AAT CCG GCG ACT GGC CAT CGA ATG CCT
arg asn ala gly gln arg ala arg arg arg gly asn pro ala thr gly his arg met pro
661/221 691/231
GCG CCA GCT CGC CGC CGT GGC CCC CGC GGT GTT CGC CGA CTT CGA GGT GAC CAC CCT GGC
ala pro ala arg arg arg gly pro arg gly val arg arg leu arg gly asp his pro gly
721/241 751/251
CGA CGG CAC CGA GGT GGC GAC CAG CCC GTT GGC GAC CGA AGC CTG AGG CGG CGT GTC GCT
arg arg his arg gly gly asp gln pro val gly asp arg ser leu arg arg arg val ala
781/261 811/271
GGA CAA ACA CGC GCG CTC GCG GCC GGG ATA AAG CGC CAG GTA ACC TTG GGA GCC GTG ACC
gly gln thr arg ala leu ala ala gly ile lys arg gln val thr leu gly ala val thr
841/281 871/291
ACC GTC GGA TTC GAC GTC GCA GCG CGC CTA GGA ACC CTG CTG ACC GCG ATG GTG ACA CCG
thr val gly phe asp val ala ala arg leu gly thr leu leu thr ala met val thr pro
901/301 931/311
TTT AGC GGC GAT GGC TCC CTG GAC ACC GCC ACC GCG GCG CGG CTG GCC AAC CAC CTG GTC
phe ser gly asp gly ser leu asp thr ala thr ala ala arg leu ala asn his leu val
961/321 991/331
GAT CAG GGG TGC GAC GGT CTG GTG GTC TCG GGC ACC ACC GGC GAG TCG CCG ACC ACC ACC
asp gln gly cys asp gly leu val val ser gly thr thr gly glu ser pro thr thr thr

SEQ ID NOS:631-632

FIG. 37E

```
1021/341                                    1051/351
GAC GGG GAG AAA ATC GAG CTG CTG CGG GCC GTC TTG GAA GCG GTG GGG GAC CGG GCC CGT
asp gly glu lys ile glu leu leu arg ala val leu glu ala val gly asp arg ala arg
1081/361                                    1111/371
GTT ATC GCC GGT GCC GGC ACC TAT GAC ACC GCG CAC AGC ATC CGG CTG GCC AAG GCT TGT
val ile ala gly ala gly thr tyr asp thr ala his ser ile arg leu ala lys ala cys
1141/381                                    1171/391
GCG GCC GAG GGT GCG CAC GGG CTG CTG GTG GTC ACG CCC TAC TAT TCC AAG CCG CCG CAG
ala ala glu gly ala his gly leu leu val val thr pro tyr tyr ser lys pro pro gln
1201/401                                    1231/411
CGG GGG CTG CAA GCC CAT TTC ACC GCC GTC GCC GAC GCG ACC GAG CTG CCG ATG CTG CTC
arg gly leu gln ala his phe thr ala val ala asp ala thr glu leu pro met leu leu
1261/421                                    1291/431
TAT GAC ATC CCG GGG CGG TCG GCG GTG CCG ATC GAG CCC GAC ACG ATC CGC GCG TTG GCG
tyr asp ile pro gly arg ser ala val pro ile glu pro asp thr ile arg ala leu ala
1321/441                                    1351/451
TCG CAT CCG AAC ATC GTC GGA GTC AAG GAC GCC AAA GCC GAC CTG CAC AGC GGC GCC CAA
ser his pro asn ile val gly val lys asp ala lys ala asp leu his ser gly ala gln
1381/461                                    1411/471
ATC ATG GCC GAC ACC GGA CTG GCC TAC TAT TCC GGC GAC GAC GCG CTC AAC CTG CCC TGG
ile met ala asp thr gly leu ala tyr tyr ser gly asp asp ala leu asn leu pro trp
1441/481                                    1471/491
CTG GCC ATG GGC GCC ACG GGC TTC ATC AGC GTG ATT GCC CAC CTG GCA GCC GGG CAG CTT
leu ala met gly ala thr gly phe ile ser val ile ala his leu ala ala gly gln leu
1501/501                                    1531/511
CGA GAG TTG TTG TCC GCC TTC GGT TCT GGG GAT ATC GCC ACC GCC CGC AAG ATC AAC ATT
arg glu leu leu ser ala phe gly ser gly asp ile ala thr ala arg lys ile asn ile
1561/521                                    1591/531
GCG GTC GCC CCG CTG TGC AAC GCG ATG AGC CGC CTG GGT GGG GTG ACG TTG TCC AAG GCG
ala val ala pro leu cys asn ala met ser arg leu gly gly val thr leu ser lys ala
1621/541                                    1651/551
GGC TTG CGG CTG CAG GGC ATC GAC GTC GGT GAT CCC CGG CTG CCC CAG GTG GCC GCG ACA
gly leu arg leu gln gly ile asp val gly asp pro arg leu pro gln val ala ala thr
1681/561                                    1711/571
CCG GAG CAG ATC GAC GCG TTG GCC GCC GAC ATG CGC GCG GCC TCG GTG CTT CGG TGA
pro glu gln ile asp ala leu ala ala asp met arg ala ala ser val leu arg)OPA
```

SEQ ID NOS:631-632 (continued 1)

FIG. 37E (continued 1)

1/1  SEQ ID NO: 633                           31/11
GCG GTG AAC TGG TGG GCC CGG ATG GTT CAA  GTA CGC CGT CGC AAA CTC GAG CAC AAC AGG
(ala val asn trp trp ala arg met val gln  val arg arg arg lys leu glu his asn arg
61/21   SEQ ID NO: 634                      91/31
AGA CGA CGG ATG GAA GGA GAT GCT GGC GCC  GGC CAG CTG AAC CCT GCC GAT GCG AAT AAG
arg arg arg met glu gly asp ala gly ala  gly gln leu asn pro ala asp ala asn lys
121/41                                    151/51
TCG TCG TCT ACG GAG GTG AAG GCG GCG GAT  TCG GCG GAA TCT GAC GCC GGA GCC GAC CAG
ser ser ser thr glu val lys ala ala asp  ser ala glu ser asp ala gly ala asp gln
181/61                                    211/71
ACT GGC CCG CAG GTG AAG GCG GCG GAT TCG  GCG GAA TCT GAC GCC GGA GAG CTC GGC GAG
thr gly pro gln val lys ala ala asp ser  ala glu ser asp ala gly glu leu gly glu
241/81                                    271/91
GAC GCG TGC CCA GAA CAG GCC CTC GTC GAG  CGG CGC CCG TCG CGG TTG CGG CGA GGC TGG
asp ala cys pro glu gln ala leu val glu  arg arg pro ser arg leu arg arg gly trp
301/101                                   331/111
CTT GTT GGC ATT GCG GCG ACG CTG CTC GCG  TTG GCC GGT GGC CTT GGC GCA GCG GGT TAT
leu val gly ile ala ala thr leu leu ala  leu ala gly gly leu gly ala ala gly tyr
361/121                                   391/131
TTT GCG TTG CGC TCA CAC CAG GAA AGC CAA  TCA ATC GCG CGC GAG GAC CTT GCG GCC ATT
phe ala leu arg ser his gln glu ser gln  ser ile ala arg glu asp leu ala ala ile
421/141                                   451/151
GAG GCC GCT AAG GAT TGC GTT GCG GCC ACG  CAG GCA CCC GAT GCT GGG GCG ATG TCG GCT
glu ala ala lys asp cys val ala ala thr  gln ala pro asp ala gly ala met ser ala
481/161
AGC ATG CAG AAG ATC
ser met gln lys ile)

SEQ ID NOS:633-634

FIG. 38A

1/1  SEQ ID NO: 635                           31/11
CAG CGG TGA ACT GGT GGG CCC GGA TGG TTC  AAG TAC GCC GTC GCA AAC TCG AGC ACA ACA
gln arg OPA(thr gly gly pro gly trp phe  lys tyr ala val ala asn ser ser thr thr
61/21       SEQ ID NO: 636                 91/31
GGA GAC GAC GGA TGG AAG GAG ATG CTG GCG  CCG GCC AGC TGA ACC CTG CCG ATG CGA ATA
gly asp asp gly trp lys glu met leu ala  pro ala ser)OPA(thr leu pro met arg ile
121/41                                    151/51     SEQ ID NO: 637
AGT CGT CGT CTA CGG AGG TGA AGG CGG CGG  ATT CGG CGG AAT CTG ACG CCG GAG CCG ACC
ser arg arg leu arg arg)OPA(arg arg arg  ile arg arg asn leu thr pro glu pro thr
181/61     SEQ ID NO: 638                 211/71
AGA CTG GCC CGC AGG TGA AGG CGG CGG ATT  CGG CGG AAT CTG ACG CCG GAG AGC TCG GCG
arg leu ala arg arg)OPA(arg arg arg ile  arg arg asn leu thr pro glu ser ser ala
241/81     SEQ ID NO: 639                 271/91
AGG ACG CGT GCC CAG AAC AGG CCC TCG TCG  AGC GGC GCC CGT CGC GGT TGC GGC GAG GCT
arg thr arg ala gln asn arg pro ser ser  ser gly ala arg arg gly cys gly glu ala
301/101                                   331/111
GGC TTG TTG GCA TTG CGG CGA CGC TGC TCG  CGT TGG CCG GTG GCC TTG GCG CAG CGG GTT
gly leu leu ala leu arg arg arg cys ser  arg trp pro val ala leu ala gln arg val
361/121                                   391/131
ATT TTG CGT TGC GCT CAC ACC AGG AAA GCC  AAT CAA TCG CGC GCG AGG ACC TTG CGG CCA
ile leu arg cys ala his thr arg lys ala  asn gln ser arg ala arg thr leu arg pro
421/141                                   451/151
TTG AGG CCG CTA AGG ATT GCG TTG CGG CCA  CGC AGG CAC CCG ATG CTG GGG CGA TGT CGG
leu arg pro leu arg ile ala leu arg pro  arg arg his pro met leu gly arg cys arg
481/161
CTA GCA TGC AGA AGA TC
leu ala cys arg arg)

SEQ ID NOS:635-639

FIG. 38B

```
1/1    SEQ ID NO: 640                        31/11
AGC GGT GAA CTG GTG GGC CCG GAT GGT TCA AGT ACG CCG TCG CAA ACT CGA GCA CAA CAG
(ser gly glu leu val gly pro asp gly ser ser thr pro ser gln thr arg ala gln gln
61/21    SEQ ID NO: 641                     91/31
GAG ACG ACG GAT GGA AGG AGA TGC TGG CGC CGG CCA GCT GAA CCC TGC CGA TGC GAA TAA
glu thr thr asp gly arg arg cys trp arg arg pro ala glu pro cys arg cys glu)OCH
121/41                                      151/51
GTC GTC GTC TAC GGA GGT GAA GGC GGC GGA TTC GGC GGA ATC TGA CGC GGA GCG ACC A
(val val val tyr gly gly glu gly gly gly phe gly gly ile)OPA(arg arg ser arg pro
181/61    SEQ ID NO: 642                    211/71        SEQ ID NO: 643
GAC TGG CCC GCA GGT GAA GGC GGC GGA TTC GGC GGA ATC TGA CGC CGG AGA GCT CGG CGA
asp trp pro ala gly glu gly gly gly phe gly gly ile)OPA(arg arg arg ala arg arg
241/81                                      271/91          SEQ ID NO: 644
GGA CGC GTG CCC AGA ACA GGC CCT CGT CGA GCG GCG CCC GTC GCG GTT GCG GCG AGG CTG
gly arg val pro arg thr gly pro arg arg ala ala pro val ala val ala ala arg leu
301/101                                     331/111
GCT TGT TGG CAT TGC GGC GAC GCT GCT CGC GTT GGC CGG TGG CCT TGG CGC AGC GGG TTA
ala cys trp his cys gly asp ala ala arg val gly arg trp pro trp arg ser gly leu
361/121                                     391/131
TTT TGC GTT GCG CTC ACA CCA GGA AAG CCA ATC AAT CGC GCG CGA GGA CCT TGC GGC CAT
phe cys val ala leu thr pro gly lys pro ile asn arg ala arg gly pro cys gly his)
421/141                                     451/151
TGA GGC CGC TAA GGA TTG CGT TGC GGC CAC GCA GGC ACC CGA TGC TGG GGC GAT GTC GGC
OPA gly arg OCH(gly leu arg cys gly his ala gly thr arg cys trp gly asp val gly)
481/161             SEQ ID NO: 645
TAG CAT GCA GAA GAT C
AMB(his ala glu asp)
    SEQ ID NO: 646
```

SEQ ID NOS:640-646

FIG. 38C

Sequence Rv0175 predicted by Cole et al., 1998 (Nature 393 537-544)
and containing seq38A

```
1/1   SEQ ID NO: 647                        31/11
GTG AAG GCG GCG GAT TCG GCG GAA TCT GAC GCC GGA GCC GAC CAG ACT GGC CCG CAG GTG
(val lys ala ala asp ser ala glu ser asp ala gly ala asp gln thr gly pro gln val
61/21  SEQ ID NO: 648                      91/31
AAG GCG GCG GAT TCG GCG GAA TCT GAC GCC GGA GAG CTC GGC GAG GAC GCG TGC CCA GAA
lys ala ala asp ser ala glu ser asp ala gly glu leu gly glu asp ala cys pro glu
121/41                                      151/51
CAG GCC CTC GTC GAG CGG CGC CCG TCG CGG TTG CGG CGA GGC TGG CTT GTT GGC ATT GCG
gln ala leu val glu arg arg pro ser arg leu arg arg gly trp leu val gly ile ala
181/61                                      211/71
GCG ACG CTG CTC GCG TTG GCC GGT GGC CTT GGC GCA GCG GGT TAT TTT GCG TTG CGC TCA
ala thr leu leu ala leu ala gly gly leu gly ala ala gly tyr phe ala leu arg ser
241/81                                      271/91
CAC CAG GAA AGC CAA TCA ATC GCG CGC GAG GAC CTT GCG GCC ATT GAG GCC GCT AAG GAT
his gln glu ser gln ser ile ala arg glu asp leu ala ala ile glu ala ala lys asp
301/101                                     331/111
TGC GTT GCG GCC ACG CAG GCA CCC GAT GCT GGG GCG ATG TCG GCT AGC ATG CAG AAG ATC
cys val ala ala thr gln ala pro asp ala gly ala met ser ala ser met gln lys ile
361/121                                     391/131
ATC GAG TGT GGC ACC GGT GAT TTC GGT GCC CAG GCG TCG TTG TAC ACC AGC ATG CTC GTC
ile glu cys gly thr gly asp phe gly ala gln ala ser leu tyr thr ser met leu val
421/141                                     451/151
GAG GCG TAT CAA GCG GCC AGC GTC CAC GTG CAA GTG ACC GAT ATG CGC GCG GCG GTC GAG
glu ala tyr gln ala ala ser val his val gln val thr asp met arg ala ala val glu
481/161                                     511/171
CGC AAC AAC AAT GAC GGG TCG GTC GAT GTT CTG GTG GCG CTC CGG GTC AAG GTG TCC AAC
arg asn asn asn asp gly ser val asp val leu val ala leu arg val lys val ser asn
541/181                                     571/191
ACC GAC TCG GAT GCC CAT GAA GTC GGC TAC CGT CTT CGG GTC CGG ATG GCA CTG GAT GAG
thr asp ser asp ala his glu val gly tyr arg leu arg val arg met ala leu asp glu
601/201                                     631/211
GGC CGC TAT AAG ATC GCC AAA CTC GAC CAG GTG ACG AAG TGA
gly arg tyr lys ile ala lys leu asp gln val thr lys)OPA
```

SEQ ID NOS:647-648

FIG. 38D

ORF according to Cole et al., 1998 (Nature 393 537-544) containing Rv0175

```
1/1   SEQ ID NO: 649                                             31/11
TGA ACT GGT GGG GCC GGA TGG TGT CAA GTA CGC CGT CGC AAA CTC GAG CAC AAC AGG AGA
OPA(thr gly gly ala gly trp cys gln val arg arg arg lys leu glu his asn arg arg
61/21    SEQ ID NO: 650                                          91/31
CGA CGG ATG GAA GGA GAT GCT GGC GCC GGC CAG CTG AAC CCT GCC GAT GCG AAT AAG TCG
arg arg met glu gly asp ala gly ala gly gln leu asn pro ala asp ala asn lys ser
121/41                                                           151/51
TCG TCT ACG GAG GTG AAG GCG GCG GAT TCG GCG GAA TCT GAC GCC GGA GCC GAC CAG ACT
ser ser thr glu val lys ala ala asp ser ala glu ser asp ala gly ala asp gln thr
181/61                                                           211/71
GGC CCG CAG GTG AAG GCG GCG GAT TCG GCG GAA TCT GAC GCC GGA GAG CTC GGC GAG GAC
gly pro gln val lys ala ala asp ser ala glu ser asp ala gly glu leu gly glu asp
241/81                                                           271/91
GCG TGC CCA GAA CAG GCC CTC GTC GAG CGG CGC CCG TCG CGG TTG CGG CGA GGC TGG CTT
ala cys pro glu gln ala leu val glu arg arg pro ser arg leu arg arg gly trp leu
301/101                                                          331/111
GTT GGC ATT GCG GCG ACG CTG CTC GCG TTG GCC GGT GGC TTG GGC GCA GCG GGT TAT TTT
val gly ile ala ala thr leu leu ala leu ala gly gly leu gly ala ala gly tyr phe
361/121                                                          391/131
GCG TTG CGC TCA CAC CAG GAA AGC CAA TCA ATC GCG CGC GAG GAC CTT GCG GCC ATT GAG
ala leu arg ser his gln glu ser gln ser ile ala arg glu asp leu ala ala ile glu
421/141                                                          451/151
GCC GCT AAG GAT TGC GTT GCG GCC ACG CAG GCA CCC GAT GCT GGG GCG ATG TCG GCT AGC
ala ala lys asp cys val ala ala thr gln ala pro asp ala gly ala met ser ala ser
481/161                                                          511/171
ATG CAG AAG ATC ATC GAG TGT GGC ACC GGT GAT TTC GGT GCC CAG GCG TCG TTG TAC ACC
met gln lys ile ile glu cys gly thr gly asp phe gly ala gln ala ser leu tyr thr
541/181                                                          571/191
AGC ATG CTC GTC GAG GCG TAT CAA GCG GCC AGC GTC CAC GTG CAA GTG ACC GAT ATG CGC
ser met leu val glu ala tyr gln ala ala ser val his val gln val thr asp met arg
601/201                                                          631/211
GCG GCG GTC GAG CGC AAC AAC AAT GAC GGG TCG GTC GAT GTT CTG GTG GCG CTC CGG GTC
ala ala val glu arg asn asn asn asp gly ser val asp val leu val ala leu arg val
661/221                                                          691/231
AAG GTG TCC AAC ACC GAC TCG GAT GCC CAT GAA GTC GGC TAC CGT CTT CGG GTC CGG ATG
lys val ser asn thr asp ser asp ala his glu val gly tyr arg leu arg val arg met
721/241                                                          751/251
GCA CTG GAT GAG GGC CGC TAT AAG ATC GCC AAA CTC GAC CAG GTG ACG AAG TGA
ala leu asp glu gly arg tyr lys ile ala lys leu asp gln val thr lys)OPA
```

SEQ ID NOS:649-650

FIG. 38E

1/1 SEQ ID NO: 651                               31/11
ACA CCT CCC CCC CCG CCG CCG CTG CCG CCG GTT CCC TTT CCC AAG GAA TGT CCG GCG CCG
(thr pro pro pro pro pro pro leu pro pro val pro phe pro lys glu cys pro ala pro
61/21   SEQ ID NO: 652                            91/31
GGC GTG ATG CAA GGC TGC CTT GAG AGC ACC AGC GGC TTG ATC ATG GGC ATC GAC AGC AAG
gly val met gln gly cys leu glu ser thr ser gly leu ile met gly ile asp ser lys
121/41                                    151/51
ACC GCA CTG GTC GCC GAG CGC ATC ACC GGT GCC GTC GAG GAG ATC
thr ala leu val ala glu arg ile thr gly ala val glu glu ile)

SEQ ID NOS:651-652

FIG. 39A

1/1 SEQ ID NO: 653                               31/11
CAC CTC CCC CCC CGC CGC CGC TGC CGC CGG TTC CCT TTC CCA AGG AAT GTC CGG CGC CGG
(his leu pro pro arg arg arg cys arg arg phe pro phe pro arg asn val arg arg arg
61/21   SEQ ID NO: 654                            91/31
GCG TGA TGC AAG GCT GCC TTG AGA GCA CCA GCG GCT TGA TCA TGG GCA TCG ACA GCA AGA
ala)OPA(cys lys ala ala leu arg ala pro ala ala)OPA(ser trp ala ser thr ala arg
121/41    SEQ ID NO: 655              151/51         SEQ ID NO: 656
CCG CAC TGG TCG CCG AGC GCA TCA CCG GTG CCG TCG AGG AGA TC
pro his trp ser pro ser ala ser pro val pro ser arg arg)

SEQ ID NOS:653-656

FIG. 39B

1/1 SEQ ID NO: 657                               31/11
GAC ACC TCC CCC CCC GCC GCC GCT GCC GCC GGT TCC CTT TCC CAA GGA ATG TCC GGC GCC
(asp thr ser pro pro ala ala ala ala ala gly ser leu ser gln gly met ser gly ala
61/21  SEQ ID NO: 658                             91/31
GGG CGT GAT GCA AGG CTG CCT TGA GAG CAC CAG CGG CTT GAT CAT GGG CAT CGA CAG CAA
gly arg asp ala arg leu pro)OPA(glu his gln arg leu asp his gly his arg gln gln
121/41           SEQ NO: 659              151/51
GAC CGC ACT GGT CGC CGA GCG CAT CAC CGG TGC CGT CGA GGA GAT C
asp arg thr gly arg arg ala his his arg cys arg arg gly asp)

SEQ ID NOS:657-659

FIG. 39C

Coding sequence Rv3006 predicted by Cole et al., 1998 (Nature 393 537-544) and containing seq39A

```
1/1    SEQ ID NO: 660                    31/11
ATG TGG ACA ACG CGG TTG GTT CGA TCC GGA CTC GCC GCG CTG TGC GCG GCA GTG CTG GTA
(Met trp thr thr arg leu val arg ser gly leu ala ala leu cys ala ala val leu val
61/21   SEQ ID NO: 661                   91/31
TCG AGC GGC TGC GCA CGG TTC AAC GAC GCT CAA TCT CAG CCG TTC ACC ACC GAA CCG GAG
ser ser gly cys ala arg phe asn asp ala gln ser gln pro phe thr thr glu pro glu
121/41                                   151/51
CTG CGG CCC CAA CCC AGC TCG ACA CCT CCC CCC CCG CCG CCG CTG CCG CCG GTT CCC TTT
leu arg pro gln pro ser ser thr pro pro pro pro pro pro leu pro pro val pro phe
181/61                                   211/71
CCC AAG GAA TGT CCG GCG CCG GGC GTG ATG CAA GGC TGC CTT GAG AGC ACC AGC GGC TTG
pro lys glu cys pro ala pro gly val met gln gly cys leu glu ser thr ser gly leu
241/81                                   271/91
ATC ATG GGC ATC GAC AGC AAG ACC GCA CTG GTC GCC GAG CGC ATC ACC GGT GCC GTC GAG
ile met gly ile asp ser lys thr ala leu val ala glu arg ile thr gly ala val glu
301/101                                  331/111
GAG ATC TCT ATC AGC GCC GAG CCG AAG GTA AAG ACG GTC ATC CCC GTG GAT CCT GCC GGT
glu ile ser ile ser ala glu pro lys val lys thr val ile pro val asp pro ala gly
361/121                                  391/131
GAC GGT GGC TTG ATG GAC ATT GTG CTG TCG CCC ACC TAC TCG CAA GAC CGG CTG ATG TAC
asp gly gly leu met asp ile val leu ser pro thr tyr ser gln asp arg leu met tyr
421/141                                  451/151
GCC TAC ATC AGC ACG CCC ACC GAC AAC CGG GTG GTG CGA GTG GCC GAC GGC GAC ATC CCC
ala tyr ile ser thr pro thr asp asn arg val val arg val ala asp gly asp ile pro
481/161                                  511/171
AAG GAC ATC CTG ACC GGC ATC CCC AAA GGT GCT GCC GGT AAC ACC GGG GCG CTG ATC TTC
lys asp ile leu thr gly ile pro lys gly ala ala gly asn thr gly ala leu ile phe
541/181                                  571/191
ACC AGT CCC ACC ACG CTG GTC GTG ATG ACC GGG GAT GCT GGC GAC CCG GCG TTG GCC GCC
thr ser pro thr thr leu val val met thr gly asp ala gly asp pro ala leu ala ala
601/201                                  631/211
GAT CCC CAA TCG TTG GCC GGT AAG GTC CTG CGT ATC GAA CAG CCC ACC ACC ATC GGC CAG
asp pro gln ser leu ala gly lys val leu arg ile glu gln pro thr thr ile gly gln
661/221                                  691/231
ACG CCG CCG ACG ACG GCG CTG TCT GGC ATC GGC TCC GGC GGC GGC TTG TGC ATC GAT CCG
thr pro pro thr thr ala leu ser gly ile gly ser gly gly gly leu cys ile asp pro
721/241                                  751/251
GTC GAC GGC TCG CTA TAT GTC GCC GAC CGC ACG CCA ACG GCG GAC CGA TTG CAG CGC ATC
val asp gly ser leu tyr val ala asp arg thr pro thr ala asp arg leu gln arg ile
781/261                                  811/271
ACC AAG AAC TCG GAG GTC TCT ACG GTA TGG ACC TGG CCG GAC AAG CCC GGC GTG GCC GGG
thr lys asn ser glu val ser thr val trp thr trp pro asp lys pro gly val ala gly
841/281                                  871/291
TGT GCC GCG ATG GAC GGC ACC GTG CTG GTC AAC CTG ATT AAT ACC AAA CTG ACG GTG GCG
cys ala ala met asp gly thr val leu val asn leu ile asn thr lys leu thr val ala
901/301                                  931/311
GTC CGG CTC GCG CCG TCG ACC GGT GCG GTC ACC GGA GAA CCC GAC GTT GTC CGC AAA GAC
val arg leu ala pro ser thr gly ala val thr gly glu pro asp val val arg lys asp
961/321                                  991/331
ACT CAT GCG CAT GCG TGG GCA TTA CGG ATG TCG CCG GAC GGC AAC GTC TGG GGA GCC ACC
thr his ala his ala trp ala leu arg met ser pro asp gly asn val trp gly ala thr
1021/341                                 1051/351
GTC AAC AAG ACC GCC GGC GAC GCC GAG AAG CTC GAC GAT GTG GTG TTC CCG CTG TTC CCG
val asn lys thr ala gly asp ala glu lys leu asp asp val val phe pro leu phe pro
1081/361                                 1111/371
CAG GGT GGC GGC TTC CCG CGC AAC AAC GAC GAC AAG ACC TGA
gln gly gly gly phe pro arg asn asn asp asp lys thr)OPA
```

SEQ ID NOS:660-661

FIG. 39D

ORF according to Cole et al., 1998 (Nature 393 537-544) and containing Rv3006

1/1 SEQ ID NO: 662                                      31/11
TAA GGC CAT TTA GTG CCG AAT TGG GGA TTT   GAG CGG CGC TTT CGC CAG ACA ATC CGC ACA
OCH(gly his leu val pro asn trp gly phe   glu arg arg phe arg gln thr ile arg thr
61/21 SEQ ID NO: 663                                    91/31
TTG ACC CTG ACC AGC CCA CCA AAA GGC CCC   AAT TGG GCC GCC ATG CCG ACA GTG CGC ACC
leu thr leu thr ser pro pro lys gly pro   asn trp ala ala met pro thr val arg thr
121/41                                                  151/51
CCG GCA GGT GGC GGC GAT GCC CAC AAT GTC   CGT AGC CTG TCG GTC ATG TGG ACA ACG CGG
pro ala gly gly gly asp ala his asn val   arg ser leu ser val met trp thr thr arg
181/61                                                  211/71
TTG GTT CGA TCC GGA CTC GCC GCG CTG TGC   GCG GCA GTG CTG GTA TCG AGC GGC TGC GCA
leu val arg ser gly leu ala ala leu cys   ala ala val leu val ser ser gly cys ala
241/81                                                  271/91
CGG TTC AAC GAC GCT CAA TCT CAG CCG TTC   ACC ACC GAA CCG GAG CTG CGG CCC CAA CCC
arg phe asn asp ala gln ser gln pro phe   thr thr glu pro glu leu arg pro gln pro
301/101                                                 331/111
AGC TCG ACA CCT CCC CCC CCG CCG CCG CTG   CCG CCG GTT CCC TTT CCC AAG GAA TGT CCG
ser ser thr pro pro pro pro pro pro leu   pro pro val pro phe pro lys glu cys pro
361/121                                                 391/131
GCG CCG GGC GTG ATG CAA GGC TGC CTT GAG   AGC ACC AGC GGC TTG ATC ATG GGC ATC GAC
ala pro gly val met gln gly cys leu glu   ser thr ser gly leu ile met gly ile asp
421/141                                                 451/151
AGC AAG ACC GCA CTG GTC GCC GAG CGC ATC   ACC GGT GCC GTC GAG GAG ATC TCT ATC AGC
ser lys thr ala leu val ala glu arg ile   thr gly ala val glu glu ile ser ile ser
481/161                                                 511/171
GCC GAG CCG AAG GTA AAG ACG GTC ATC CCC   GTG GAT CCT GCC GGT GAC GGT GGC TTG ATG
ala glu pro lys val lys thr val ile pro   val asp pro ala gly asp gly gly leu met
541/181                                                 571/191
GAC ATT GTG CTG TCG CCC ACC TAC TCG CAA   GAC CGG CTG ATG TAC GCC TAC ATC AGC ACG
asp ile val leu ser pro thr tyr ser gln   asp arg leu met tyr ala tyr ile ser thr
601/201                                                 631/211
CCC ACC GAC AAC CGG GTG GTG CGA GTG GCC   GAC GGC GAC ATC CCC AAG GAC ATC CTG ACC
pro thr asp asn arg val val arg val ala   asp gly asp ile pro lys asp ile leu thr
661/221                                                 691/231
GGC ATC CCC AAA GGT GCT GCC GGT AAC ACC   GGG GCG CTG ATC TTC ACC AGT CCC ACC ACG
gly ile pro lys gly ala ala gly asn thr   gly ala leu ile phe thr ser pro thr thr
721/241                                                 751/251
CTG GTC GTG ATG ACC GGG GAT GCT GGC GAC   CCG GCG TTG GCC GCC GAT CCC CAA TCG TTG
leu val val met thr gly asp ala gly asp   pro ala leu ala ala asp pro gln ser leu
781/261                                                 811/271
GCC GGT AAG GTC CTG CGT ATC GAA CAG CCC   ACC ACC ATC GGC CAG ACG CCG CCG ACG ACG
ala gly lys val leu arg ile glu gln pro   thr thr ile gly gln thr pro pro thr thr
841/281                                                 871/291
GCG CTG TCT GGC ATC GGC TCC GGC GGC GGC   TTG TGC ATC GAT CCG GTC GAC GGC TCG CTA
ala leu ser gly ile gly ser gly gly gly   leu cys ile asp pro val asp gly ser leu
901/301                                                 931/311
TAT GTC GCC GAC CGC ACG CCA ACG GCG GAC   CGA TTG CAG CGC ATC ACC AAG AAC TCG GAG
tyr val ala asp arg thr pro thr ala asp   arg leu gln arg ile thr lys asn ser glu

SEQ ID NOS:662-663

FIG. 39E

```
961/321                                           991/331
GTC TCT ACG GTA TGG ACC TGG CCG GAC AAG CCC GGC GTG GCC GGG TGT GCC GCG ATG GAC
val ser thr val trp thr trp pro asp lys pro gly val ala gly cys ala ala met asp
1021/341                                          1051/351
GGC ACC GTG CTG GTC AAC CTG ATT AAT ACC AAA CTG ACG GTG GCG GTC CGG CTC GCG CCG
gly thr val leu val asn leu ile asn thr lys leu thr val ala val arg leu ala pro
1081/361                                          1111/371
TCG ACC GGT GCG GTC ACC GGA GAA CCC GAC GTT GTC CGC AAA GAC ACT CAT GCG CAT GCG
ser thr gly ala val thr gly glu pro asp val val arg lys asp thr his ala his ala
1141/381                                          1171/391
TGG GCA TTA CGG ATG TCG CCG GAC GGC AAC GTC TGG GGA GCC ACC GTC AAC AAG ACC GCC
trp ala leu arg met ser pro asp gly asn val trp gly ala thr val asn lys thr ala
1201/401                                          1231/411
GGC GAC GCC GAG AAG CTC GAC GAT GTG GTG TTC CCG CTG TTC CCG CAG GGT GGC GGC TTC
gly asp ala glu lys leu asp asp val val phe pro leu phe pro gln gly gly gly phe
1261/421
CCG CGC AAC AAC GAC GAC AAG ACC TGA
pro arg asn asn asp asp lys thr)OPA
```

SEQ ID NOS:662-663 (continued)

FIG. 39E (continued)

```
1/1   SEQ ID NO: 664                              31/11
GAA GGC CTT GTT GAG CCG GCG CAC GAA AAC GAT CGT TGT GTG TAC ATT GGT GTG TAT GGC
(glu gly leu val glu pro ala his glu asn asp arg cys val tyr ile gly val tyr gly
61/21    SEQ ID NO: 665                           91/31
TCG GTT GAA CGT GTA TGT GCC CGA CGA ATT GGC GGA GCG CGC CAG GGC GCG GGG CTT GAA
ser val glu arg val cys ala arg arg ile gly gly ala arg gln gly ala gly leu glu
121/41                                            151/51
CGT CTC GGC GCT GAC TCA GGC CGC GAT CAG TGC CGA GTT GGA GAA CTC CGC AAC CGA TGC
arg leu gly ala asp ser gly arg asp gln cys arg val gly glu leu arg asn arg cys
181/61                                            211/71
GTG GCT TGA GGG GTT GGA ACC CAG AAG CAC CGG CGC TCG GCA TGA TGA CGT GCT GGG TGC
val ala)OPA(gly val gly thr gln lys his arg arg ser ala)OPA OPA(arg ala gly cys
241/81         SEQ ID NO: 931                     271/91               SEQ ID NO: 932
GAT CGA TGC CGC TCG CGA TGA GTT CGA AGC GTG AGA GCA TCG CCC ACT TCG CCG CCG GAG
asp arg cys arg ser arg)OPA(val arg ser val arg ala ser pro thr ser pro pro glu
301/101    SEQ ID NO: 933                         331/111
CAG GTG GTC GTC GAC GCG AGT GCC ATG GTG GAT C
gln val val val asp ala ser ala met val asp)
```

SEQ ID NOS:664-665, 931-933

FIG. 40A

```
1/1    SEQ ID NO: 666                      31/11
AAG GCC TTG TTG AGC CGG CGC ACG AAA ACG ATC GTT GTG TGT ACA TTG GTG TGT ATG GCT
(lys ala leu leu ser arg arg thr lys thr ile val val cys thr leu val cys met ala
61/21  SEQ ID NO: 667                      91/31
CGG TTG AAC GTG TAT GTG CCC GAC GAA TTG GCG GAG CGC GCC AGG GCG CGG GGC TTG AAC
arg leu asn val tyr val pro asp glu leu ala glu arg ala arg ala arg gly leu asn
121/41                                     151/51
GTC TCG GCG CTG ACT CAG GCC GCG ATC AGT GCC GAG TTG GAG AAC TCC GCA ACC GAT GCG
val ser ala leu thr gln ala ala ile ser ala glu leu glu asn ser ala thr asp ala
181/61                                     211/71
TGG CTT GAG GGG TTG GAA CCC AGA AGC ACC GGC GCT CGG CAT GAT GAC GTG CTG GGT GCG
trp leu glu gly leu glu pro arg ser thr gly ala arg his asp asp val leu gly ala
241/81                                     271/91
ATC GAT GCC GCT CGC GAT GAG TTC GAA GCG TGA GAG CAT CGC CCA CTT CGC CGC CGG AGC
ile asp ala ala arg asp glu phe glu ala)OPA(glu his arg pro leu arg arg arg ser
301/101                                    331/111  SEQ ID NO: 668
AGG TGG TCG TCG ACG CGA GTG CCA TGG TGG ATC
arg trp ser ser thr arg val pro trp trp ile)
```

SEQ ID NOS:666-668

FIG. 40B

```
1/1    SEQ ID NO: 669                      31/11
AGG CCT TGT TGA GCC GGC GCA CGA AAA CGA TCG TTG TGT GTA CAT TGG TGT GTA TGG CTC
arg pro cys OPA(ala gly ala arg lys arg ser leu cys val his trp cys val trp leu
61/21          SEQ ID NO: 670              91/31
GGT TGA ACG TGT ATG TGC CCG ACG AAT TGG CGG AGC GCG CCA GGG CGC GGG GCT TGA ACG
gly)OPA(thr cys met cys pro thr asn trp arg ser ala pro gly arg gly ala)OPA(thr
121/41  SEQ ID NO: 671                     151/51         SEQ ID NO: 672
TCT CGG CGC TGA CTC AGG CCG CGA TCA GTG CCG AGT TGG AGA ACT CCG CAA CCG ATG CGT
ser arg arg)OPA(leu arg pro arg ser val pro ser trp arg thr pro gln pro met arg
181/61           SEQ ID NO: 673            211/71
GGC TTG AGG GGT TGG AAC CCA GAA GCA CCG GCG CTC GGC ATG ATG ACG TGC TGG GTG CGA
gly leu arg gly trp asn pro glu ala pro ala leu gly met met thr cys trp val arg
241/81                                     271/91
TCG ATG CCG CTC GCG ATG AGT TCG AAG CGT GAG AGC ATC GCC CAC TTC GCC GCC GGA GCA
ser met pro leu ala met ser ser lys arg glu ser ile ala his phe ala ala gly ala
301/101
GGT GGT CGT CGA CGC GAG TGC CAT GGT GGA TC
gly gly arg arg arg glu cys his gly gly)
```

SEQ ID NOS:669-673

FIG. 40C

Coding sequence Rv0549c predicted by Cole et al., 1998 (Nature 393:537-544) and containing seq40A

```
1/1    SEQ ID NO: 674              31/11
gtg aga gca tcg ccc act tcg ccg ccg gag cag gtg gtc gtc gac gcg agt gcc atg gtg
(val arg ala ser pro thr ser pro pro glu gln val val val asp ala ser ala met val
61/21   SEQ ID NO: 675             91/31
gat cta ctg gct cgc act agc gat cgg tgc tct gcg gtg cgc gcg cgg ctg gct cgg acc
asp leu leu ala arg thr ser asp arg cys ser ala val arg ala arg leu ala arg thr
121/41                             151/51
gcg atg cac gcg ccg gcg cac ttc gat gca gag gtg ttg tcg gcg ctg ggg cgc atg cag
ala met his ala pro ala his phe asp ala glu val leu ser ala leu gly arg met gln
181/61                             211/71
cgc gcc ggc gca ctc acc gtt gcc tat gtc gat gcg gca ctg gag gag ttg cga cag gtg
arg ala gly ala leu thr val ala tyr val asp ala ala leu glu glu leu arg gln val
241/81                             271/91
ccg gtg act cga cac ggt ctt tcg tcg ctg ctt gct gga gcg tgg tcg cgc cgc gac acc
pro val thr arg his gly leu ser ser leu leu ala gly ala trp ser arg arg asp thr
301/101                            331/111
ctc cgc ctg acc gat gcc ctc tac gtc gag ctg gcc gaa acg gca ggt ctg gtg ttg ttg
leu arg leu thr asp ala leu tyr val glu leu ala glu thr ala gly leu val leu leu
361/121                            391/131
acc acc gac gaa aga ttg gca cgc gcc tgg ccc tcg gct cac gcc atc ggc tga
thr thr asp glu arg leu ala arg ala trp pro ser ala his ala ile gly)OPA
```

SEQ ID NOS:674-675

FIG. 40D

ORF according to Cole et al., 1998 (Nature 393:537-544) and containing Rv0549c

```
1/1    SEQ ID NO: 676              31/11
tga gtt cga agc gtg aga gca tcg ccc act tcg ccg ccg gag cag gtg gtc gtc gac gcg
OPA(val arg ser val arg ala ser pro thr ser pro pro glu gln val val val asp ala
61/21   SEQ ID NO: 677             91/31
agt gcc atg gtg gat cta ctg gct cgc act agc gat cgg tgc tct gcg gtg cgc gcg cgg
ser ala met val asp leu leu ala arg thr ser asp arg cys ser ala val arg ala arg
121/41                             151/51
ctg gct cgg acc gcg atg cac gcg ccg gcg cac ttc gat gca gag gtg ttg tcg gcg ctg
leu ala arg thr ala met his ala pro ala his phe asp ala glu val leu ser ala leu
181/61                             211/71
ggg cgc atg cag cgc gcc ggc gca ctc acc gtt gcc tat gtc gat gcg gca ctg gag gag
gly arg met gln arg ala gly ala leu thr val ala tyr val asp ala ala leu glu glu
241/81                             271/91
ttg cga cag gtg ccg gtg act cga cac ggt ctt tcg tcg ctg ctt gct gga gcg tgg tcg
leu arg gln val pro val thr arg his gly leu ser ser leu leu ala gly ala trp ser
301/101                            331/111
cgc cgc gac acc ctc cgc ctg acc gat gcc ctc tac gtc gag ctg gcc gaa acg gca ggt
arg arg asp thr leu arg leu thr asp ala leu tyr val glu leu ala glu thr ala gly
361/121                            391/131
ctg gtg ttg ttg acc acc gac gaa aga ttg gca cgc gcc tgg ccc tcg gct cac gcc atc
leu val leu leu thr thr asp glu arg leu ala arg ala trp pro ser ala his ala ile
421/141
ggc tga
gly)OPA
```

SEQ ID NOS:676-677

FIG. 40E

1/1 ─────SEQ ID NO:678                          31/11
CCT GGC CGG GAC GCC TAC GTG TAG CCC GCG GCT AGC ACA GGA TAG CCA TTG TTG TGC GGT
(pro gly arg asp ala tyr val)AMB(pro ala ala ser thr gly)AMB(pro leu leu cys gly
61/21 ─SEQ ID NO: 679    SEQ ID NO: 680  91/31                    ─SEQ ID NO: 681
AGC GCC AAA ACG ATC AGC CCT TCG CGG ACA TGT CAG CAC CCG CCT TGG CCG GGA GAG CGG
ser ala lys thr ile ser pro ser arg thr cys gln his pro pro trp pro gly glu arg
121/41                                  151/51
CGT CGT GAC CGT GCT GTC ACC ACG TCT GGT TAG GCT CGG GGC GCG GGC TGG CGC GGA GGA
arg arg asp arg ala val thr thr ser gly)AMB(ala arg gly ala gly trp arg gly gly
181/61                                  211/71 ─SEQ ID NO: 682
GGT GTG TTG CGG AGG AGG TGT GTT GTA GTG GGG ACG GCG GAT CGG CCG TTG GAC GCC TCG
gly val leu arg arg arg cys val val val gly thr ala asp arg pro leu asp ala ser
241/81                                  271/91
GCC TTG CGG GAC TGG GCA CAC GCC GTC GTC AGC GAT C
ala leu arg asp trp ala his ala val val ser asp)

SEQ ID NOS:678-682

FIG. 41A

1/1 ─SEQ ID NO: 683                        31/11
CTG GCC GGG ACG CCT ACG TGT AGC CCG CGG CTA GCA CAG GAT AGC CAT TGT TGT GCG GTA
(leu ala gly thr pro thr cys ser pro arg leu ala gln asp ser his cys cys ala val
61/21 ─SEQ ID NO: 684                    91/31
GCG CCA AAA CGA TCA GCC TTC GCG GA CAT GTC AGC ACC CGC CTT GGC CGG GAG AGC GGC
ala pro lys arg ser ala leu arg gly his val ser thr arg leu gly arg glu ser gly
121/41                                  151/51
GTC GTG ACC GTG CTG TCA CCA CGT CTG GTT AGG CTC GGG GCG CGG GCT GGC GCG GAG GAG
val val thr val leu ser pro arg leu val arg leu gly ala arg ala gly ala glu glu
181/61                                  211/71
GTG TGT TGC GGA GGA GGT GTG TTG TAG TGG GGA CGG CGG ATC GGC CGT TGG ACG CCT CGG
val cys cys gly gly gly val leu)AMB(trp gly arg arg ile gly arg trp thr pro arg
241/81            SEQ ID NO: 685         271/91
CCT TGC GGG ACT GGG CAC ACG CCG TCG TCA GCG ATC
pro cys gly thr gly his thr pro ser ser ala ile)

SEQ ID NOS:683-685

FIG. 41B

1/1 SEQ ID NO: 686                          31/11
TGG CCG GGA CGC CTA CGT GTA GCC CGC GGC TAG CAC AGG ATA GCC ATT GTT GTG CGG TAG
(trp pro gly arg leu arg val ala arg gly)AMB(his arg ile ala ile val val arg)AMB
61/21 SEQ ID NO: 687                        91/31 SEQ ID NO: 688
CGC CAA AAC GAT CAG CCC TTC GCG GAC ATG TCA GCA CCC GCC TTG GCC GGG AGA GCG GCG
(arg gln asn asp gln pro phe ala asp met ser ala pro ala leu ala gly arg ala ala
121/41 SEQ ID NO: 689                       151/51
TCG TGA CCG TGC TGT CAC CAC GTC TGG TTA GGC TCG GGG CGC GGG CTG GCG CGG AGG AGG
ser)OPA(pro cys cys his his val trp leu gly ser gly arg gly leu ala arg arg arg
181/61 SEQ ID NO: 690                       211/71
TGT GTT GCG GAG GAG GTG TGT TGT AGT GGG GAC GGC GGA TCG GCC GTT GGA CGC CTC GGC
cys val ala glu glu val cys cys ser gly asp gly gly ser ala val gly arg leu gly
241/81                                      271/91
CTT GCG GGA CTG GGC ACA CGC CGT CGT CAG CGA TC
leu ala gly leu gly thr arg arg arg gln arg)

SEQ ID NOS:686-690

FIG. 41C

Coding sequence Rv2975c predicted by Cole et al. 1998 (Nature 393: 537-544) and
containing seq41A 1/1 SEQ ID NO: 691                          31/11
gtg ggg acg gcg gat cgg ccg ttg gac gcc tcg gcc ttg cgg gac tgg gca cac gcc gtc
(val gly thr ala asp arg pro leu asp ala ser ala leu arg asp trp ala his ala val
61/21 SEQ ID NO: 692                        91/31
gtc agc gat ctg atc ctc cac atc gac gag atc aac cgg ctc aat gtg ttc ccg gtc gct
val ser asp leu ile leu his ile asp glu ile asn arg leu asn val phe pro val ala
121/41                                      151/51
gac tcc gat acc ggc gtc aac atg ctg ttc acc atg cgt gcc gcg gtc gta gaa gct gat
asp ser asp thr gly val asn met leu phe thr met arg ala ala val val glu ala asp
181/61                                      211/71
ttg cac gcg aat tcg cag gct gac gcc gaa gac gtg gcg cgg gtt gcg gcc gct ctc gcg
leu his ala asn ser gln ala asp ala glu asp val ala arg val ala ala ala leu ala
241/81
gcc ggc gcg cgt tga
ala gly ala arg)OPA

SEQ ID NOS:691-692

FIG. 41D

ORF according to Cole et al, 1998 (Nature 393: 537-544) and containing Rv2975c

```
1/1   SEQ ID NO: 693                          31/11
tag gct cgg ggc gcg ggc tgg cgc gga gga ggt gtg ttg cgg agg agg tgt gtt gta gtg
AMB(ala arg gly ala gly trp arg gly gly gly val leu arg arg arg cys val val val
61/21   SEQ ID NO: 694                        91/31
ggg acg gcg gat cgg ccg ttg gac gcc tcg gcc ttg cgg gac tgg gca cac gcc gtc gtc
gly thr ala asp arg pro leu asp ala ser ala leu arg asp trp ala his ala val val
121/41                                        151/51
agc gat ctg atc ctc cac atc gac gag atc aac cgg ctc aat gtg ttc ccg gtc gct gac
ser asp leu ile leu his ile asp glu ile asn arg leu asn val phe pro val ala asp
181/61                                        211/71
tcc gat acc ggc gtc aac atg ctg ttc acc atg cgt gcc gcg gtc gta gaa gct gat ttg
ser asp thr gly val asn met leu phe thr met arg ala ala val val glu ala asp leu
241/81                                        271/91
cac gcg aat tcg cag gct gac gcc gaa gac gtg gcg cgg gtt gcg gcc gct ctc gcg gcc
his ala asn ser gln ala asp ala glu asp val ala arg val ala ala ala leu ala ala
301/101
ggc gcg cgt tga
gly ala arg)OPA
```

SEQ ID NOS:693-694

FIG. 41E sequence Rv 2974C predicted by Cole et al. (Nature 393:537-544) and which may be in the same reading frame as Seq41D. The sequencing of this region reveals, in one case out of three, a deletion of two nucleotides putting in phase observed in

```
1/1   SEQ ID NO: 695                          31/11
ttg aac gga gct cgc ggc aac tcc ggc gtg atc ctg tcc cag atc ctg cgc ggg atc gca
(leu asn gly ala arg gly asn ser gly val ile leu ser gln ile leu arg gly ile ala
61/21   SEQ ID NO: 696                        91/31
gag gtg acc gcg act gcg gcc gcc gcc tct ggc gcg gta ttg cgg gcg gtc gac gcc aac
glu val thr ala thr ala ala ala ala ser gly ala val leu arg ala val asp ala asn
121/41                                        151/51
gcc ctc ggg gcc gcg ttg tgg cgc ggc gtc gag ttg gtc gtc gcg tcg atg ggt ggc gtg
ala leu gly ala ala leu trp arg gly val glu leu val val ala ser met gly gly val
181/61                                        211/71
gag gtg ccg gga act atc gtc tcg gtg ctg cgg gcc gcc gcc gga gcc gtc gac cag tgc
glu val pro gly thr ile val ser val leu arg ala ala ala gly ala val asp gln cys
241/81                                        271/91
gcg cac gag ggg ttg gcc ggt gcg gtc acc gcc gcc ggt gac gcg gcg gtc atc gcg ctg
ala his glu gly leu ala gly ala val thr ala ala gly asp ala ala val ile ala leu
301/101                                       331/111
gaa aag acc ccc gaa cag ctt gac gtg ctc gcc gat gcg ggc gcg gtg gac gcc ggc gga
glu lys thr pro glu gln leu asp val leu ala asp ala gly ala val asp ala gly gly
```

SEQ ID NOS:695-696

FIG. 41F

```
361/121                                     391/131
cgg ggc ctg ctg gtt ctg ctg gac gcg ttg     cgc tcc acc atc tgc ggg cag gca cct gcc
arg gly leu leu val leu leu asp ala leu     arg ser thr ile cys gly gln ala pro ala
421/141                                     451/151
cgg gcg gtc tac gaa ccc tcg ccg cgc gcg     ttg ccg acc gac acg gct acc caa cgc ccc
arg ala val tyr glu pro ser pro arg ala     leu pro thr asp thr ala thr gln arg pro
481/161                                     511/171
gcc ccg caa ttc gag gtg atg tat ctg ttg     gcg gta tgt gat gct gca gcg gcg gac cag
ala pro gln phe glu val met tyr leu leu     ala val cys asp ala ala ala ala asp gln
541/181                                     571/191
ttg cgg gat cga ctc aag gaa ttg ggt gag     tcg gtg gcc atc gcc gct gct ccg ccc gac
leu arg asp arg leu lys glu leu gly glu     ser val ala ile ala ala ala pro pro asp
601/201                                     631/211
agc tac tcc gta cac gtc cac acc gac gac     gcc ggt gcc gcc gtg gaa gcc gga ttg gcg
ser tyr ser val his val his thr asp asp     ala gly ala ala val glu ala gly leu ala
661/221                                     691/231
gtg ggg cga gtt agc cgg atc gtg atc tcg     gcg ctc ggt tcc ggg acc agc gga ttg ccg
val gly arg val ser arg ile val ile ser     ala leu gly ser gly thr ser gly leu pro
721/241                                     751/251
gcc ggt ggc tgg acg cgg ggc cgc gcc gtg     ctg gcg gtc gtc gac ggc gac ggt gcc gcc
ala gly gly trp thr arg gly arg ala val     leu ala val val asp gly asp gly ala ala
781/261                                     811/271
gag ctg ttc gcc ggg gag ggc gcc tgc gtg     ctg cga ccg ggt cca gac gcc gtg aca ccg
glu leu phe ala gly glu gly ala cys val     leu arg pro gly pro asp ala val thr pro
841/281                                     871/291
gcc gcc gat atc agt gcc cac cag ctg gtg     cgg gcc gtg gta gac acc ggc gcc gcg cac
ala ala asp ile ser ala his gln leu val     arg ala val val asp thr gly ala ala his
901/301                                     931/311
gtg atg gtg ctg ccc aat ggc tat gtg gcc     gcc gaa gaa ctg gtg gcc ggg tgt acc gcg
val met val leu pro asn gly tyr val ala     ala glu glu leu val ala gly cys thr ala
961/321                                     991/331
gcg atc ggc tgg ggc gtc gac gtg gta ccc     gtg ccg acc gga tcg atg gtg cag ggg ttg
ala ile gly trp gly val asp val val pro     val pro thr gly ser met val gln gly leu
1021/341                                    1051/351
gcc gcg ctg gcc gtg cat gac gcg gcc cgc     cag gcc gtc gac gac ggc tac agc atg gcc
ala ala leu ala val his asp ala ala arg     gln ala val asp asp gly tyr ser met ala
1081/361                                    1111/371
cgt gcc gcc ggt gct tcc cgg cac gga tcg     gtg cgc att gcc acc caa aag gcg ctg acc
arg ala ala gly ala ser arg his gly ser     val arg ile ala thr gln lys ala leu thr
1141/381                                    1171/391
tgg gcc ggt acc tgc aag ccg ggc gac ggt     ctg ggt atc gcg ggc gac gag gtg ctg atc
trp ala gly thr cys lys pro gly asp gly     leu gly ile ala gly asp glu val leu ile
1201/401                                    1231/411
gtc gcc gac gat gtc gcc gcg gcg gcc atc     ggt ctg gtc gac ctg ttg ttg gca tcg gga
val ala asp asp val ala ala ala ala ile     gly leu val asp leu leu leu ala ser gly
1261/421                                    1291/431
ggc gat ctg gtg acg gtg cta att ggc gcc     ggc gta acc gaa gac gtg gct gtc gtc ctg
gly asp leu val thr val leu ile gly ala     gly val thr glu asp val ala val val leu
1321/441                                    1351/451
gaa cgg cat gtg cac gac cac cat cca ggc     acc gag ctg gtc tcc tac cgc acc gga cac
glu arg his val his asp his his pro gly     thr glu leu val ser tyr arg thr gly his
1381/461                                    1411/471
cgc ggc gac gcg ctg ctg atc ggg gtc gag tag
arg gly asp ala leu leu ile gly val glu)AMB
```

SEQ ID NOS:695-696 (continued)

SEQ ID NO: 697: first reading frame nucleic acid
SEQ ID NO: 702: second reading frame nucleic acid
SEQ ID NO: 717: third reading frame nucleic acid
Seq41T comprising seq 41F and seq 41S — SEQ ID NO: 698
1/1 SEQ ID NO: 697,702,717                31/11
tta ggc tcg ggg cgc ggg ctg gcg cgg agg agg tgt gtt gcg gag gag gtg tgt tgt agt
leu gly ser gly arg gly leu ala arg arg arg cys val ala glu glu val cys cys ser
 AMB(ala arg gly ala gly trp arg gly gly gly val leu arg arg arg cys val val val
  (arg leu gly ala arg ala gly ala glu glu val cys cys gly gly gly val leu)AMB(trp
61/21  SEQ ID NO: 703  SEQ ID NO: 718    91/31              SEQ ID NO: 719
ggg gac ggc gga tcg gcc gtt gga cgc ctc ggc ctt gcg gga ctg ggc aca cgc cgt cgt
gly asp gly gly ser ala val gly arg leu gly leu ala gly leu gly thr arg arg arg
 gly thr ala asp arg pro leu asp ala ser ala leu arg asp trp ala his ala val val
  gly arg arg ile gly arg trp thr pro arg pro cys gly thr gly his thr pro ser ser
121/41                         151/51
cag cga tct gat cct cca cat cga cga gat caa ccg gct caa tgt gtt ccc ggt cgc tga
gln arg ser asp pro pro his arg arg asp gln pro ala gln cys val pro gly arg)OPA
 ser asp leu ile leu his ile asp glu ile asn arg leu asn val phe pro val ala asp
  ala ile)OPA(ser ser thr arg ser thr gly ser met cys ser arg ser leu thr
181/61          SEQ ID NO: 720      211/71
ctc cga tac cgg cgt caa cat gct gtt cac cat gcg tgc cgc ggt cgt aga agc tga ttt
(leu arg tyr arg arg gln his ala val his his ala cys arg gly arg arg ser)OPA(phe
  ser asp thr gly val asn met leu phe thr met arg ala ala val val glu ala asp leu
   pro ile pro ala ser thr cys cys ser pro cys val pro arg ser)AMB(lys leu ile)cys
241/81  SEQ ID NO: 699          271/91 SEQ ID NO: 721  SEQ ID NO: 700
gca cgc gaa ttc gca ggc tga cgc cga aga cgt ggc gcg ggt tgc ggc cgc tct cgc ggc
ala arg glu phe ala gly)OPA(arg arg arg arg gly ala gly cys gly arg ser arg gly
 his ala asn ser gln ala asp ala glu asp val ala arg val ala ala ala leu ala ala
  thr arg ile arg arg leu thr) pro lys thr trp arg gly leu arg pro leu ser arg pro
301/101      SEQ ID NO: 701           331/111
cgg cgc gcg ttg aac gga gct cgc ggc aac tcc ggc gtg atc ctg tcc cag atc ctg cgc
arg arg ala leu asn gly ala arg gly asn ser gly val ile leu ser gln ile leu arg
 gly ala arg)OPA(thr glu leu ala ala thr pro ala)OPA(ser cys pro arg ser cys ala
  ala arg val glu arg ser ser arg gln leu arg arg asp pro val pro asp pro ala arg
361/121              SEQ ID NO: 704    391/131         SEQ ID NO: 705
ggg atc gca gag gtg acc gcg act gcg gcc gcc gcc tct ggc gcg gta ttg cgg gcg gtc
gly ile ala glu val thr ala thr ala ala ala ala ser gly ala val leu arg ala val
 gly ser gln arg)OPA(pro arg leu arg pro pro pro leu ala arg tyr cys gly arg ser
  asp arg arg gly asp arg asp cys gly arg arg leu trp arg gly ile ala gly gly arg
421/141            SEQ ID NO: 706    451/151
gac gcc aac gcc ctc ggg gcc gcg ttg tgg cgc ggc gtc gag ttg gtc gtc gcg tcg atg
asp ala asn ala leu gly ala ala leu trp arg gly val glu leu val val ala ser met
 thr pro thr pro ser gly pro arg cys gly ala ala ser ser trp ser ser arg arg trp
  arg gln arg pro arg gly arg val val ala arg arg arg val gly arg arg val asp gly
481/161                         511/171
ggt ggc gtg gag gtg ccg gga act atc gtc tcg gtg ctg cgg gcc gcc gcc gga gcc gtc
gly gly val glu val pro gly thr ile val ser val leu arg ala ala ala gly ala val
 val ala trp arg cys arg glu cys ser ser arg cys cys gly pro pro pro glu pro ser
  trp arg gly gly ala gly asn tyr arg leu gly ala ala gly arg arg arg ser arg arg
541/181                         571/191
gac cag tgc gcg cac gag ggg ttg gcc ggt gcg gtc acc gcc gcc ggt gac gcg gcg gtc
asp gln cys ala his glu gly leu ala gly ala val thr ala ala gly asp ala ala val
 thr ser ala arg thr arg gly trp pro val arg ser pro pro pro val thr arg arg ser
  pro val arg ala arg gly val gly arg arg cys gly his arg arg arg)OPA(arg gly gly his
601/201                        631/211   SEQ ID NO: 722
atc gcg ctg gaa aag acc ccc gaa cag ctt gac gtg ctc gcc gat gcg ggc gcg gtg gac
ile ala leu glu lys thr pro glu gln leu asp val leu ala asp ala gly ala val asp
 ser arg trp lys arg pro pro asn ser leu thr cys ser pro met arg ala arg trp thr
  arg ala gly lys asp pro arg thr ala)OPA(arg ala arg arg cys gly arg gly arg
661/221                        691/231  SEQ ID NO: 723
gcc ggc gga cgg ggc ctg ctg gtt ctg ctg gac gcg ttg cgc tcc acc atc tgc ggg cag
ala gly gly arg gly leu leu val leu leu asp ala leu arg ser thr ile cys gly gln
 pro ala asp gly ala cys trp phe cys trp thr arg cys ala pro pro ser ala gly arg
  arg arg thr gly pro ala gly ser ala gly arg val ala leu his his leu arg ala gly

SEQ ID NOS:697-727

FIG. 41G

```
721/241                              751/251
gca cct gcc cgg gcg gtc tac gaa ccc tcg ccg cgc gcg ttg ccg acc gac acg gct acc
ala pro ala arg ala val tyr glu pro ser pro arg ala leu pro thr asp thr ala thr
 his leu pro gly arg ser thr asn pro arg arg ala arg cys arg pro thr arg leu pro
   thr cys pro gly gly leu arg thr leu ala ala arg val ala asp arg his gly tyr pro
781/261                              811/271
caa cgc ccc gcc ccg caa ttc gag gtg atg tat ctg ttg gcg gta tgt gat gct gca gcg
gln arg pro ala pro gln phe glu val met tyr leu leu ala val cys asp ala ala ala
 asn ala pro pro arg asn ser arg)OPA(cys ile cys trp arg tyr val met leu gln arg
   thr pro arg pro ala ile arg gly/asp val ser val gly gly met)OPA(cys cys ser gly
841/281         SEQ ID NO: 707              871/291    SEQ ID NO: 724
gcg gac cag ttg cgg gat cga ctc aag gaa ttg ggt gag tcg gtg gcc atc gcc gct gct
ala asp gln leu arg asp arg leu lys glu leu gly glu ser val ala ile ala ala ala
 arg thr ser cys gly ile asp ser arg asn trp val ser arg trp pro ser pro leu leu
   gly pro val ala gly ser thr gln gly ile gly)OPA(val gly gly his arg arg cys ser
901/301                              931/311      SEQ ID NO: 725
ccg ccc gac agc tac tcc gta cac gtc cac acc gac gac gcc ggt gcc gcc gtg gaa gcc
pro pro asp ser tyr ser val his val his thr asp asp ala gly ala ala val glu ala
 arg pro thr ala thr pro tyr thr ser thr pro thr thr pro val pro pro trp lys pro
   ala arg gln leu leu arg thr arg pro his arg arg arg arg cys arg arg gly ser arg
961/321                              991/331
gga ttg gcg gtg ggg cga gtt agc cgg atc gtg atc tcg gcg ctc ggt tcc ggg acc agc
gly leu ala val gly arg val ser arg ile val ile ser ala leu gly ser gly thr ser
 asp trp arg trp gly glu leu ala gly ser)OPA(ser arg arg ser val pro gly pro ala
   ile gly gly gly ala ser)AMB(pro asp arg asp leu gly ala arg phe arg asp gln arg
1021/341        SEQ ID NO: 726              1051/351        SEQ ID NO: 708
gga ttg ccg gcc ggt ggc tgg acg cgg ggc cgc gcc gtg ctg gcg gtc gtc gac ggc gac
gly leu pro ala gly gly trp thr arg gly arg ala val leu ala val val asp gly asp
 asp cys arg pro val ala gly arg gly ala ala pro cys trp arg ser ser thr ala thr
   ile ala gly arg trp leu asp ala gly pro arg arg ala gly gly arg arg arg arg arg
1081/361                             1111/371
ggt gcc gcc gag ctg ttc gcc ggg gag ggc gcc tgc gtg ctg cga ccg ggt cca gac gcc
gly ala ala glu leu phe ala gly glu gly ala cys val leu arg pro gly pro asp ala
 val pro pro ser cys ser pro gly arg ala pro ala cys cys asp arg val gln thr pro)
   cys arg arg ala val arg arg gly gly arg leu arg ala ala thr gly ser arg arg arg
1141/381                             1171/391
gtg aca ccg gcc gcc gat atc agt gcc cac cag ctg gtg cgg gcc gtg gta gac acc ggc
val thr pro ala ala asp ile ser ala his gln leu val arg ala val val asp thr gly
 OPA(his arg pro pro ile ser val pro thr ser trp cys gly pro trp)AMB(thr pro ala
   asp thr\gly arg arg tyr gln cys pro pro ala gly ala gly arg gly arg)his arg arg
1201/401    SEQ ID NO: 709                  1231/411     SEQ ID NO: 710
gcc gcg cac gtg atg gtg ctg ccc aat ggc tat gtg gcc gcc gaa gaa ctg gtg gcc ggg
ala ala his val met val leu pro asn gly tyr val ala ala glu glu leu val ala gly
 pro arg thr)OPA(trp cys cys pro met ala met trp pro pro lys asn trp trp pro gly
   arg ala arg asp\gly ala ala gln trp leu cys gly arg arg arg thr gly gly arg val
1261/421             SEQ ID NO: 711         1291/431
tgt acc gcg gcg atc ggc tgg ggc gtc gac gtg gta ccc gtg ccg acc gga tcg atg gtg
cys thr ala ala ile gly trp gly val asp val val pro val pro thr gly ser met val
 val pro arg arg ser ala gly ala ser thr trp tyr pro cys arg pro asp arg trp cys
   tyr arg gly asp arg leu gly arg arg arg gly thr arg ala asp arg ile asp gly ala
1321/441                             1351/451
cag ggg ttg gcc gcg ctg gcc gtg cat gac gcg gcc cgc cag gcc gtc gac gac ggc tac
gln gly leu ala ala leu ala val his asp ala ala arg gln ala val asp asp gly tyr
 arg gly trp pro arg trp pro cys met thr arg pro ala arg pro ser thr thr ala thr
   gly val gly arg ala gly arg ala)OPA(arg gly pro pro gly arg arg arg arg leu gln
1381/461        SEQ ID NO: 727              1411/471
agc atg gcc cgt gcc gcc ggt gct tcc cgg cac gga tcg gtg cgc att gcc acc caa aag
ser met ala arg ala ala gly ala ser arg his gly ser val arg ile ala thr gln lys
 ala trp pro val pro pro val leu pro gly thr asp arg cys ala leu pro pro lys arg
   his gly pro cys arg arg cys phe pro ala arg ile gly ala his cys his pro lys gly
```

SEQ ID NOS:697-727 (continued 1)

FIG. 41G (continued 1)

```
1441/481                              1471/491
gcg ctg acc tgg gcc ggt acc tgc aag ccg ggc gac ggt ctg ggt atc gcg ggc gac gag
ala leu thr trp ala gly thr cys lys pro gly asp gly leu gly ile ala gly asp glu
 arg)OPA(pro gly pro val pro ala ser arg ala thr val trp val ser arg ala thr arg
   ala asp leu gly arg tyr leu gln ala gly arg arg ser gly tyr arg gly arg arg gly
1501/501     SEQ ID NO: 712           1531/511
gtg ctg atc gtc gcc gac gat gtc gcc gcg gcg gcc atc ggt ctg gtc gac ctg ttg ttg
val leu ile val ala asp asp val ala ala ala ala ile gly leu val asp leu leu leu
 cys)OPA(ser ser pro thr met ser pro arg arg pro ser val trp ser thr cys cys trp
   ala asp arg arg arg arg cys arg arg gly gly his arg ser gly arg pro val val gly
1561/521     SEQ ID NO: 713           1591/531
gca tcg gga ggc gat ctg gtg acg gtg cta att ggc gcc ggc gta acc gaa gac gtg gct
ala ser gly gly asp leu val thr val leu ile gly ala gly val thr glu asp val ala
 his arg gly ala ile trp)OPA arg cys OCH(leu ala pro ala)OCH(pro lys thr trp leu
   ile gly arg arg ser gly asp gly ala/asn trp arg arg arg asn arg arg arg gly cys
1621/541        SEQ ID NO: 714         1651/551            SEQ ID NO: 715
gtc gtc ctg gaa cgg cat gtg cac gac cac cat cca ggc acc gag ctg gtc tcc tac cgc
val val leu glu arg his val his asp his his pro gly thr glu leu val ser tyr arg
 ser ser trp asn gly met cys thr thr thr ile gln ala pro ser trp ser pro thr ala
   arg pro gly thr ala cys ala arg pro pro ser arg his arg ala gly leu leu pro his
1681/561                              1711/571
acc gga cac cgc ggc gac gcg ctg ctg atc ggg gtc gag tag
thr gly his arg gly asp ala leu leu ile gly val glu)AMB
 pro asp thr ala ala thr arg cys)OPA(ser gly ser)ser
   arg thr pro arg arg arg ala ala asp arg gly arg val
              SEQ ID NO: 716
```

SEQ ID NOS:697-727 (continued 2)

FIG. 41G (continued 2)

```
1/1     SEQ ID NO: 728               31/11
GCC GGT AAC GCC GCG TCC CAG TGC TAT CCG TCC GCC GGA CCG CCC GAA ACA TCA GCG GCG
(ala gly asn ala ala ser gln cys tyr pro ser ala gly pro pro glu thr ser ala ala
61/21    SEQ ID NO: 729              91/31
GGC GCC CCG GTC GGC CGC GGC CGG GCT CGA CCC GCT CCA CCT GGC CAT CAG CGA CCA GGT
gly ala pro val gly arg gly arg ala arg pro ala pro pro gly his gln arg pro gly
121/41                               151/51
TAT CGA GGT GGA AGC GGA CGG TGT TGG GAT GCA CGC CCA ACT TGC GGG CGA TCG CGG CGA
tyr arg gly gly ser gly arg cys trp asp ala arg pro thr cys arg arg ser arg arg
181/61                               211/71
TGC TCA TCG GAA CCC GCG ACG CAC ACA ATG CCC GCA GCA CCG CAC GAC GGC GCC CCA CCG
cys ser ser glu pro ala thr his thr met pro ala ala pro his asp gly ala pro pro
241/81                               271/91
GCT CTT GCA GTG ACC TGA TGA TGA CAC TCA CCC CCA TAA GGC TCG TCG GCT GCG CCT GAG
ala leu ala val thr)OPA OPA OPA(his ser pro pro)OCH(gly ser ser ala ala pro glu
301/101        SEQ ID NO:730          331/111      SEQ ID NO: 731
CAA TGC AGT AAG TTT ACA CAA ACG GAC TTG TAA AAA CCT GCG GAG GTG GGT CTA TGG CC
gln cys ser lys phe thr gln thr asp leu)OCH(lys pro ala glu val gly ser met ala
361/121                              391/131  SEQ ID NO: 732
AAC AAA CGT GGC AAT GCC GGG CAG CCT CTG CCC TTG TCG GAT C
asn lys arg gly asn ala gly gln pro leu pro leu ser asp)
```

SEQ ID NOS:728-732

FIG. 42A

```
1
1/1  SEQ ID NO: 733                              31/11
CCG GTA ACG CCG CGT CCC AGT GCT ATC CGT CCG CCG GAC CGC CCG AAA CAT CAG CGG CGG
(pro val thr pro arg pro ser ala ile arg pro pro asp arg pro lys his gln arg arg
61/21   SEQ ID NO: 734                           91/31
GCG CCC CGG TCG GCC GCG GCC GGG CTC GAC CCG CTC CAC CTG GCC ATC AGC GAC CAG GTT
ala pro arg ser ala ala ala gly leu asp pro leu his leu ala ile ser asp gln val
121/41                                           151/51
ATC GAG GTG GAA GCG GAC GGT GTT GGG ATG CAC GCC CAA CTT GCC GGC GAT CGC GGC GAT
ile glu val glu ala asp gly val gly met his ala gln leu ala gly asp arg gly asp
181/61                                           211/71
GCT CAT CGG AAC CCG CGA CGC ACA CAA TGC CCG CAG CAC CGC ACG ACG GCG CCC CAC CGG
ala his arg asn pro arg arg thr gln cys pro gln his arg thr thr ala pro his arg
241/81                                           271/91
CTC TTG CAG TGA CCT GAT GAT GAC ACT CAC CCC CAT AAG GCT CGT CGG CTG CGC CTG AGC
leu leu gln)OPA(pro asp asp asp thr his pro his lys ala arg arg leu arg leu ser
301/101         SEQ ID NO: 735                   331/111
AAT GCA GTA AGT TTA CAC AAA CGG ACT TGT AAA AAC CTG CGG AGG TGG GGT CTA TGG CCA
asn ala val ser leu his lys arg thr cys lys asn leu arg arg trp gly leu trp pro
361/121                                          391/131
ACA AAC GTG GCA ATG CCG GGC AGC CTC TGC CCT TGT CGG ATC
thr asn val ala met pro gly ser leu cys pro cys arg ile)

SEQ ID NOS:733-735

FIG. 42B

1/1  SEQ ID NO: 736                              31/11
CGG TAA CGC CGC GTC CCA GTG CTA TCC GTC CGC CGG ACC GCC CGA AAC ATC AGC GGC GGG
arg OCH(arg arg val pro val leu ser val arg arg thr ala arg asn ile ser gly gly
61/21   SEQ ID NO: 737                           91/31
CGC CCC GGT CGG CCG CGG CCG GGC TCG ACC CGC TCC ACC TGG CCA TCA GCG ACC AGG TTA
arg pro gly arg pro arg pro gly ser thr arg ser thr trp pro ser ala thr arg leu
121/41                                           151/51
TCG AGG TGG AAG CGG ACG GTG TTG GGA TGC ACG CCC AAC TTG CCG GCG ATC GCG GCG ATG
ser arg trp lys arg thr val leu gly cys thr pro asn leu pro ala ile ala ala met
181/61                                           211/71
CTC ATC GGA ACC CGC GAC GCA CAC AAT GCC CGC AGC ACC GCA CGA CGG CGC CCC ACC GGC
leu ile gly thr arg asp ala his asn ala arg ser thr ala arg arg pro thr gly
241/81                                           271/91
TCT TGC AGT GAC CTG ATG ATG ACA CTC ACC CCC ATA AGG CTC GTC GGC TGC GCC TGA GCA
ser cys ser asp leu met met thr leu thr pro ile arg leu val gly cys ala)OPA ala
301/101                                          331/111
ATG CAG TAA GTT TAC ACA AAC GGA CTT GTA AAA ACC TGC GGA GGT GGG GTC TAT GGC CAA
met gln OCH(val tyr thr asn gly leu val lys thr cys gly gly gly val tyr gly gln
361/121         SEQ ID NO: 738                   391/131
CAA ACG TGG CAA TGC CGG GCA GCC TCT GCC CTT GTC GGA TC
gln thr trp gln cys arg ala ala ser ala leu val gly)

SEQ ID NOS:736-738

FIG. 42C
```

Coding sequence Rv2622 predicted by Cole et al., 1998 (Nature 393:537-544)
and containing seq42A:

```
1/1   SEQ ID NO: 739                          31/11
atg gcc aac aaa cgt ggc aat gcc ggg cag   cct ctg ccc ttg tcg gat cga gac gac gac
(Met ala asn lys arg gly asn ala gly gln  pro leu pro leu ser asp arg asp asp asp
61/21    SEQ ID NO: 740                       91/31
cac atg cag ggg cac tgg ctg ctg gcc cgg   ctg ggc aag cgg gtg ctg cgt ccc ggc ggc
his met gln gly his trp leu leu ala arg   leu gly lys arg val leu arg pro gly gly
121/41                                       151/51
gtc gaa ctc acc cgg aca ctg ctg gcc cgc   gcc gag gtg acc gac gcc gac gtg ctc gag
val glu leu thr arg thr leu leu ala arg   ala glu val thr asp ala asp val leu glu
181/61                                       211/71
ctg gca ccg ggc ctg ggc cgc acc gca gcc   gaa atc ttg gcc cgc aac ccg cgg tcg tac
leu ala pro gly leu gly arg thr ala ala   glu ile leu ala arg asn pro arg ser tyr
241/81                                       271/91
gtg ggg gcg gag agc gat ccc aac gcg gcc   aac ctg gtc cga cac gtt ctc gcc ggc cgc
val gly ala glu ser asp pro asn ala ala   asn leu val arg his val leu ala gly arg
301/101                                      331/111
ggc gac gtc cgg gtc acc gac gcg gcc gat   acc gga tta tcc gac gcc agc gcc gat gtc
gly asp val arg val thr asp ala ala asp   thr gly leu ser asp ala ser ala asp val
361/121                                      391/131
gtc atc ggc gag gcg atg ctg acc atg caa   ggc aac gcg gct aaa cac acg atc gtc gcc
val ile gly glu ala met leu thr met gln   gly asn ala ala lys his thr ile val ala
421/141                                      451/151
gag gcg gcg cgg gtg ctg agg ccg ggt ggc   cgc tac gcg att cac gaa cta gcg ctg gtg
glu ala ala arg val leu arg pro gly gly   arg tyr ala ile his glu leu ala leu val
481/161                                      511/171
ccg gac gac gtc gca gag cag gtc cgc acc   gac ctg cgg cag tcg ctg gcc cgc gcg ctc
pro asp asp val ala glu gln val arg thr   asp leu arg gln ser leu ala arg ala leu
541/181                                      571/191
aag gtc aat gcg cgt ccg ctg acc gtt gcg   gaa tgg tcg cac ctc tta gcg ggc cat gga
lys val asn ala arg pro leu thr val ala   glu trp ser his leu leu ala gly his gly
601/201                                      631/211
ctg gtc gtc gaa cac gtt gtc acc gct tcc   atg gcg ttg tta caa ccg cga cgg gtg atc
leu val val glu his val val thr ala ser   met ala leu leu gln pro arg arg val ile
661/221                                      691/231
gct gac gaa ggc ctc ctg ggt gcg ctg cgg   ttc gcc gga aac ctg ctc atc cat cgt gcc
ala asp glu gly leu leu gly ala leu arg   phe ala gly asn leu leu ile his arg ala
721/241                                      751/251
gcg cgt cgg cga gtc ctg ttg atg cgc cac   aca ttc cgc agg cat cgt gaa cgc ttg aca
ala arg arg arg val leu leu met arg his   thr phe arg arg his arg glu arg leu thr
781/261                                      811/271
gcc gtc gcc att gtc gcg cac aaa ccg cac   gtc gat tcg tga
ala val ala ile val ala his lys pro his   val asp ser)OPA
```

SEQ ID NOS:739-740

FIG. 42D

ORF according to Cole et al., 1998 (Nature 393:537-544) and containing Rv2622

```
1/1    SEQ ID NO: 741                          31/11
taa aaa cct gcg gag gtg ggg tct atg gcc aac aaa cgt ggc aat gcc ggg cag cct ctg
OCH(lys pro ala glu val gly ser met ala asn lys arg gly asn ala gly gln pro leu
61/21   SEQ ID NO: 742                         91/31
ccc ttg tcg gat cga gac gac gac cac atg cag ggg cac tgg ctg ctg gcc cgg ctg ggc
pro leu ser asp arg asp asp asp his met gln gly his trp leu leu ala arg leu gly
121/41                                         151/51
aag cgg gtg ctg cgt ccc ggc ggc gtc gaa ctc acc cgg aca ctg ctg gcc cgc gcc gag
lys arg val leu arg pro gly gly val glu leu thr arg thr leu leu ala arg ala glu
181/61                                         211/71
gtg acc gac gcc gac gtg ctc gag ctg gca ccg ggc ctg ggc cgc acc gca gcc gaa atc
val thr asp ala asp val leu glu leu ala pro gly leu gly arg thr ala ala glu ile
241/81                                         271/91
ttg gcc cgc aac ccg cgg tcg tac gtg ggg gcg gag agc gat ccc aac gcg gcc aac ctg
leu ala arg asn pro arg ser tyr val gly ala glu ser asp pro asn ala ala asn leu
301/101                                        331/111
gtc cga cac gtt ctc gcc ggc cgc ggc gac gtc cgg gtc acc gac gcg gcc gat acc gga
val arg his val leu ala gly arg gly asp val arg val thr asp ala ala asp thr gly
361/121                                        391/131
tta tcc gac gcc agc gcc gat gtc gtc atc ggc gag gcg atg ctg acc atg caa ggc aac
leu ser asp ala ser ala asp val val ile gly glu ala met leu thr met gln gly asn
421/141                                        451/151
gcg gct aaa cac acg atc gtc gcc gag gcg gcg cgg gtg ctg agg ccg ggt ggc cgc tac
ala ala lys his thr ile val ala glu ala ala arg val leu arg pro gly gly arg tyr
481/161                                        511/171
gcg att cac gaa cta gcg ctg gtg ccg gac gac gtc gca gag cag gtc cgc acc gac ctg
ala ile his glu leu ala leu val pro asp asp val ala glu gln val arg thr asp leu
541/181                                        571/191
cgg cag tcg ctg gcc cgc gcg ctc aag gtc aat gcg cgt ccg ctg acc gtt gcg gaa tgg
arg gln ser leu ala arg ala leu lys val asn ala arg pro leu thr val ala glu trp
601/201                                        631/211
tcg cac ctc tta gcg ggc cat gga ctg gtc gtc gaa cac gtt gtc acc gct tcc atg gcg
ser his leu leu ala gly his gly leu val val glu his val val thr ala ser met ala
661/221                                        691/231
ttg tta caa ccg cga cgg gtg atc gct gac gaa ggc ctc ctg ggt gcg ctg cgg ttc gcc
leu leu gln pro arg arg val ile ala asp glu gly leu leu gly ala leu arg phe ala
721/241                                        751/251
gga aac ctg ctc atc cat cgt gcc gcg cgt cgg cga gtc ctg ttg atg cgc cac aca ttc
gly asn leu leu ile his arg ala ala arg arg arg val leu leu met arg his thr phe
781/261                                        811/271
cgc agg cat cgt gaa cgc ttg aca gcc gtc gcc att gtc gcg cac aaa ccg cac gtc gat
arg arg his arg glu arg leu thr ala val ala ile val ala his lys pro his val asp
841/281
tcg tga
ser)OPA
```

SEQ ID NOS:741-742

FIG. 42E

1/1 SEQ ID NO: 743                          31/11
atc gcg cgt gac atc gat gac cag ggt cgg ctg tgt ctg gac gtc ggc ggt cga acg gta
(ile ala arg asp ile asp asp gln gly arg leu cys leu asp val gly gly arg thr val
61/21    SEQ ID NO: 744                     91/31
gtt gtt tca gcg ggc gac gtg gtg cat ttg cgt taa ctc gcg cgg agc tgg cgt ccc caa
val val ser ala gly asp val val his leu arg)OCH(leu ala arg ser trp arg pro gln
121/41                                      151/51   SEQ ID NO: 745
aag att aag gtc gcg ggc atg agc tat ccg gag aat gtc ctg gcc gct ggc gag cag gtc
lys ile lys val ala gly met ser tyr pro glu asn val leu ala ala gly glu gln val
181/61                                      211/71
gtt ctg cac cgc cat ccg cac tgg aat cgc tta atc tgg ccc gtc gtg gtg ctg gtc ttg
val leu his arg his pro his trp asn arg leu ile trp pro val val val leu val leu
241/81                                      271/91
ctg acc ggg ttg gcg gcg ttc ggg tcc gga ttc gtc aac tcg aca cct tgg cag cag atc
leu thr gly leu ala ala phe gly ser gly phe val asn ser thr pro trp gln gln ile)

SEQ ID NOS:743-745

FIG. 43A

1/1  SEQ ID NO: 746                         31/11
tcg cgc gtg aca tcg atg acc agg gtc ggc tgt gtc tgg acg tcg gcg gtc gaa cgg tag
(ser arg val thr ser met thr arg val gly cys val trp thr ser ala val glu arg)AMB
61/21 SEQ ID NO: 747                        91/31
ttg ttt cag cgg gcg acg tgg tgc att tgc gtt aac tcg cgc gga gct ggc gtc ccc aaa
(leu phe gln arg ala thr trp cys ile cys val asn ser arg gly ala gly val pro lys
121/41    SEQ ID NO: 748                    151/51
aga tta agg tcg cgg gca tga gct atc cgg aga atg tcc tgg ccg ctg cga gca ggt cg
arg leu arg ser arg ala)OPA(ala ile arg arg met ser trp pro leu ala ser arg ser
181/61     SEQ ID NO: 749                   211/71
ttc tgc acc gcc atc cgc act gga atc gct aat ctg gcc gtc tgg tgc tgg tct tgc
phe cys thr ala ile arg thr gly ile ala)OCH(ser gly pro ser trp cys trp ser cys)
241/81                                      271/91    SEQ ID NO: 750
tga ccg ggt tgg cgg cgt tcg ggt ccg gat tcg tca act cga cac ctt ggc agc aga tc
OPA(pro gly trp arg arg ser gly pro asp ser ser thr arg his leu gly ser arg)
       SEQ ID NO: 751

SEQ ID NOS:746-751

FIG. 43B

1/1 SEQ ID NO: 752                          31/11
cgc gcg tga cat cga tga cca ggg tcg gct gtg tct gga cgt cgg cgg tcg aac ggt agt
arg ala OPA his arg OPA(pro gly ser ala val ser gly arg arg arg ser asn gly ser
61/21  SEQ ID NO: 753                       91/31
tgt ttc agc ggg cga cgt ggt gca ttt gcg tta act cgc gcg gag ctg gcg tcc cca aaa
cys phe ser gly arg arg gly ala phe ala leu thr arg ala glu leu ala ser pro lys
121/41                                      151/51
gat taa ggt cgc ggg cat gag cta tcc gga gaa tgt cct ggc cgc tgg cga gca ggt cgt
asp)OCH(gly arg gly his glu leu ser gly glu cys pro gly arg trp arg ala gly arg
181/61    SEQ ID NO: 754                    211/71
tct gca ccg cca tcc gca ctg gaa tcg ctt aat ctg gcc cgt cgt ggt gct ggt ctt gct
ser ala pro pro ser ala leu glu ser leu asn leu ala arg arg gly ala gly leu ala
241/81                                      271/91
gac cgg gtt ggc ggc gtt cgg gtc cgg att cgt caa ctc gac acc ttg gca gca gat c
asp arg val gly gly val arg val arg ile arg gln leu asp thr leu ala ala asp)

SEQ ID NOS:752-754

FIG. 43C

Coding sequence Rv3278c predicted by Cole et al., 1998 (Nature 393:537-544)
and containing seq43A:

1/1  SEQ ID NO: 755                         31/11
atg agc tat ccg gag aat gtc ctg gcc gct ggc gag cag gtc gtt ctg cac cgc cat ccg
(Met ser tyr pro glu asn val leu ala ala gly glu gln val val leu his arg his pro
61/21  SEQ ID NO: 756                       91/31
cac tgg aat cgc tta atc tgg ccc gtc gtg gtg ctg gtc ttg ctg acc ggg ttg gcg gcg
his trp asn arg leu ile trp pro val val val leu val leu leu thr gly leu ala ala
121/41                                      151/51
ttc ggg tcc gga ttc gtc aac tcg aca cct tgg cag cag atc gct aag aac gtg att cac
phe gly ser gly phe val asn ser thr pro trp gln gln ile ala lys asn val ile his
181/61                                      211/71
gcg gtc atc tgg ggg atc tgg ttg gtg atc gtc ggc tgg ctc acg ctg tgg cca ttc ctg
ala val ile trp gly ile trp leu val ile val gly trp leu thr leu trp pro phe leu
241/81                                      271/91
agc tgg ctg acc aca cat ttc gtg gtg acc aac cgg cgg gtg atg ttc cgg cat ggt gtg
ser trp leu thr thr his phe val val thr asn arg arg val met phe arg his gly val
301/101                                     331/111
ctg acc cgc agc ggg atc gac ata ccg cta gca cgg atc aac agc gtg gag ttc cgg gac
leu thr arg ser gly ile asp ile pro leu ala arg ile asn ser val glu phe arg asp
361/121                                     391/131
cgg atc ttc gag cgg att ttt cgc acc ggg acg ttg att atc gag tcc gcg tca caa gat
arg ile phe glu arg ile phe arg thr gly thr leu ile ile glu ser ala ser gln asp
421/141                                     451/151
ccg ctc gag ttc tac aac att ccg cgc ctg cgg gag gtg cat gcg ttg ctg tat cac gag
pro leu glu phe tyr asn ile pro arg leu arg glu val his ala leu leu tyr his glu
481/161                                     511/171
gtt ttc gac acc ctg ggc tcc gac gag tcg ccc agc tga
val phe asp thr leu gly ser asp glu ser pro ser)OPA

SEQ ID NOS:755-756

FIG. 43D

ORF according to Cole et al., 1998 (Nature 393:537-544) and containing Rv3278c

```
1/1  SEQ ID NO: 757                      31/11
taa ctc gcg cgg agc tgg cgt ccc caa aag att aag gtc gcg ggc atg agc tat ccg gag
OCH(leu ala arg ser trp arg pro gln lys ile lys val ala gly met ser tyr pro glu
61/21  SEQ ID NO: 758                                91/31
aat gtc ctg gcc gct ggc gag cag gtc gtt ctg cac cgc cat ccg cac tgg aat cgc tta
asn val leu ala ala gly glu gln val val leu his arg his pro his trp asn arg leu
121/41                                   151/51
atc tgg ccc gtc gtg gtg ctg gtc ttg ctg acc ggg ttg gcg gcg ttc ggg tcc gga ttc
ile trp pro val val val leu val leu leu thr gly leu ala ala phe gly ser gly phe
181/61                                   211/71
gtc aac tcg aca cct tgg cag cag atc gct aag aac gtg att cac gcg gtc atc tgg ggg
val asn ser thr pro trp gln gln ile ala lys asn val ile his ala val ile trp gly
241/81                                   271/91
atc tgg ttg gtg atc gtc ggc tgg ctc acg ctg tgg cca ttc ctg agc tgg ctg acc aca
ile trp leu val ile val gly trp leu thr leu trp pro phe leu ser trp leu thr thr
301/101                                  331/111
cat ttc gtg gtg acc aac cgg cgg gtg atg ttc cgg cat ggt gtg ctg acc cgc agc ggg
his phe val val thr asn arg arg val met phe arg his gly val leu thr arg ser gly
361/121                                  391/131
atc gac ata ccg cta gca cgg atc aac agc gtg gag ttc cgg gac cgg atc ttc gag cgg
ile asp ile pro leu ala arg ile asn ser val glu phe arg asp arg ile phe glu arg
421/141                                  451/151
att ttt cgc acc ggg acg ttg att atc gag tcc gcg tca caa gat ccg ctc gag ttc tac
ile phe arg thr gly thr leu ile ile glu ser ala ser gln asp pro leu glu phe tyr
481/161                                  511/171
aac att ccg cgc ctg cgg gag gtg cat gcg ttg ctg tat cac gag gtt ttc gac acc ctg
asn ile pro arg leu arg glu val his ala leu leu tyr his glu val phe asp thr leu
541/181
ggc tcc gac gag tcg ccc agc tga
gly ser asp glu ser pro ser)OPA
```

SEQ ID NOS:757-758

FIG. 43E

1/1 SEQ ID NO: 759                               31/11
gcc aag atg gat gtc tac caa cgc acc gcc gcc ggc tgg cag ccg ctc aag acc ggt atc
(ala lys met asp val tyr gln arg thr ala ala gly trp gln pro leu lys thr gly ile
61/21 SEQ ID NO: 760                             91/31
acc acc cat atc ggt tcg gcg ggc atg gcg ccg gaa gcc aag agc gga tat ccg gcc act
thr thr his ile gly ser ala gly met ala pro glu ala lys ser gly tyr pro ala thr
121/41                                           151/51
ccg atg ggg gtt tac agc ctg gac tcc gct ttt ggc acc gcg ccg aat ccc ggt ggc ggg
pro met gly val tyr ser leu asp ser ala phe gly thr ala pro asn pro gly gly gly
181/61                                           211/71
ttg ccg tat acc caa gtc gga ccc aat cac tgg tgg agt ggc gac gac aat agc ccc acc
leu pro tyr thr gln val gly pro asn his trp trp ser gly asp asp asn ser pro thr
241/81                                           271/91
ttt aac tcc atg cag gtc tgt cag aag tcc cag tgc ccg ttc agc acg gcc gac agc gag
phe asn ser met gln val cys gln lys ser gln cys pro phe ser thr ala asp ser glu
301/101                                          331/111
aac ctg caa atc ccg cag tac aag cat tcg gtc gtg atg ggc gtc aac aag gcc aag gtc
asn leu gln ile pro gln tyr lys his ser val val met gly val asn lys ala lys val
361/121                                          391/131
cca ggc aaa ggc tcc gcg ttc ttc ttt cac acc acc gac ggc ggg ccc acc gcg ggt tgt
pro gly lys gly ser ala phe phe phe his thr thr asp gly gly pro thr ala gly cys
421/141
gtg gcg atc
val ala ile)

SEQ ID NOS:759-760

FIG. 44A

1/1 SEQ ID NO: 761                               31/11
cca aga tgg atg tct acc aac gca ccg ccg ccg gct ggc agc cgc tca aga ccg gta tca
(pro arg trp met ser thr asn ala pro pro pro ala gly ser arg ser arg pro val ser
61/21 SEQ ID NO: 762                             91/31
cca ccc ata tcg gtt cgg cgg gca tgg cgc cgg aag cca aga gcg gat atc cgg cca ctc
pro pro ile ser val arg arg ala trp arg arg lys pro arg ala asp ile arg pro leu
121/41                                           151/51
cga tgg ggg ttt aca gcc tgg act ccg ctt ttg gca ccg cgc gaa tcc ggt gcg ggt
arg trp gly phe thr ala trp thr pro leu leu ala pro arg arg ile pro val ala gly
181/61                                           211/71
tgc cgt ata ccc aag tcg gac cca atc act ggt gga gtg gcg acg aca ata gcc cca cct
cys arg ile pro lys ser asp pro ile thr gly gly val ala thr thr ile ala pro pro
241/81                                           271/91
tta act cca tgc agg tct gtc aga agt ccc agt gcc gtt cag cac ggc cga cag cga ga
leu thr pro cys arg ser val arg ser pro ser ala arg ser ala arg pro thr ala arg
301/101                                          331/111
acc tgc aaa tcc cgc agt aca agc att cgg tcg tga tgg cgt caa cag gcc agg tcc
thr cys lys ser arg ser thr ser ile arg ser)OPA(trp ala ser thr arg pro arg ser
361/121                                          391/131 SEQ ID NO: 763
cag gca aag gct ccg cgt tct tct tca aca cca ccg acg gcg ggc cca ccg cgg gtt gtg
gln ala lys ala pro arg ser ser phe thr pro pro thr ala gly pro pro arg val val
421/141
tgg cga tc
trp arg)

SEQ ID NOS:761-763

FIG. 44B

```
1/1  SEQ ID NO: 764                            31/11
caa gat gga tgt cta cca acg cac cgc cgc cgg ctg gca gcc gct caa gac cgg tat cac
(gln asp gly cys leu pro thr his arg arg arg leu ala ala ala gln asp arg tyr his
61/21  SEQ ID NO: 765                          91/31
cac cca tat cgg ttc ggc ggg cat ggc gcc gga agc caa gag cgg ata tcc ggc cac tcc
his pro tyr arg phe gly gly his gly ala gly ser gln glu arg ile ser gly his ser
121/41                                         151/51
gat ggg ggt tta cag cct gga ctc cgc ttt tgg cac cgc gcc gaa tcc cgg tgg cgg gtt
asp gly gly leu gln pro gly leu arg phe trp his arg ala glu ser arg trp arg val
181/61                                         211/71
gcc gta tac cca agt cgg acc caa tca ctg gtg gag tgg cga cga caa tag ccc cac ctt
ala val tyr pro ser arg thr gln ser leu val glu trp arg arg gln)AMB pro his leu
241/81                                         271/91
taa ctc cat gca ggt ctg tca gaa gtc cca gtg ccc gtt cag cac ggc cga cag cga gaa
OCH(leu his ala gly leu ser glu val pro val pro val gln his gly arg gln arg glu
301/101  SEQ ID NO: 766                        331/111
cct gca aat ccc gca gta caa gca ttc ggt cgt gat ggg cgt caa caa ggc caa ggt ccc
pro ala asn pro ala val gln ala phe gly arg asp gly arg gln gln gly gln gly pro
361/121                                        391/131
agg caa agg ctc cgc gtt ctt ctt tca cac cac cga cgg cgg gcc cac cgc ggg ttg tgt
arg gln arg leu arg val leu leu ser his his arg arg arg ala his arg gly leu cys
421/141
ggc gat c
gly asp)
```

SEQ ID NOS:764-766

FIG. 44C

Coding sequence Rv0309 predicted by Cole et al., 1998 (Nature 393:537-544)
and containing Seq44A:

```
1/1   SEQ ID NO: 767                      31/11
atg agc cga ctc cta gct ttg ctg tgc gct gcg gta tgc acg ggc tgc gtt gct gtg gtt
(Met ser arg leu leu ala leu leu cys ala ala val cys thr gly cys val ala val val
61/21   SEQ ID NO: 768                    91/31
ctc gcg cca gtg agc ctg gcc gtc gtc aac ccg tgg ttc gcg aac tcg gtc ggc aat gcc
leu ala pro val ser leu ala val val asn pro trp phe ala asn ser val gly asn ala
121/41                                    151/51
act cag gtg gtt tcg gtg gtg gga acc ggc ggt tcg acg gcc aag atg gat gtc tac caa
thr gln val val ser val val gly thr gly gly ser thr ala lys met asp val tyr gln
181/61                                    211/71
cgc acc gcc gcc ggc tgg cag ccg ctc aag acc ggt atc acc acc cat atc ggt tcg gcg
arg thr ala ala gly trp gln pro leu lys thr gly ile thr thr his ile gly ser ala
241/81                                    271/91
ggc atg gcg ccg gaa gcc aag agc gga tat ccg gcc act ccg atg ggg gtt tac agc ctg
gly met ala pro glu ala lys ser gly tyr pro ala thr pro met gly val tyr ser leu
301/101                                   331/111
gac tcc gct ttt ggc acc gcg ccg aat ccc ggt ggc ggg ttg ccg tat acc caa gtc gga
asp ser ala phe gly thr ala pro asn pro gly gly gly leu pro tyr thr gln val gly
361/121                                   391/131
ccc aat cac tgg tgg agt ggc gac gac aat agc ccc acc ttt aac tcc atg cag gtc tgt
pro asn his trp trp ser gly asp asp asn ser pro thr phe asn ser met gln val cys
421/141                                   451/151
cag aag tcc cag tgc ccg ttc agc acg gcc gac agc gag aac ctg caa atc ccg cag tac
gln lys ser gln cys pro phe ser thr ala asp ser glu asn leu gln ile pro gln tyr
481/161                                   511/171
aag cat tcg gtc gtg atg ggc gtc aac aag gcc aag gtc cca ggc aaa ggc tcc gcg ttc
lys his ser val val met gly val asn lys ala lys val pro gly lys gly ser ala phe
541/181                                   571/191
ttc ttt cac acc acc gac ggc ggg ccc acc gcg ggt tgt gtg gcg atc gac gat gcc acg
phe phe his thr thr asp gly gly pro thr ala gly cys val ala ile asp asp ala thr
601/201                                   631/211
ctg gtg cag atc atc cgt tgg ctg cgg cct ggt gcg gtg atc gcg atc gcc aag taa
leu val gln ile ile arg trp leu arg pro gly ala val ile ala ile ala lys)OCH
```

SEQ ID NOS:767-768

FIG. 44D

ORF according to Cole et al., 1998 (Nature 393:537-544) and containing Rv0309

```
1/1 SEQ ID NO: 769                              31/11
tga gcg atg agc cga ctc cta gct ttg ctg tgc gct gcg gta tgc acg ggc tgc gtt gct
OPA(ala met ser arg leu leu ala leu leu cys ala ala val cys thr gly cys val ala
61/21   SEQ ID NO: 770                          91/31
gtg gtt ctc gcg cca gtg agc ctg gcc gtc gtc aac ccg tgg ttc gcg aac tcg gtc ggc
val val leu ala pro val ser leu ala val val asn pro trp phe ala asn ser val gly
121/41                                          151/51
aat gcc act cag gtg gtt tcg gtg gtg gga acc ggc ggt tcg acg gcc aag atg gat gtc
asn ala thr gln val val ser val val gly thr gly gly ser thr ala lys met asp val
181/61                                          211/71
tac caa cgc acc gcc gcc ggc tgg cag ccg ctc aag acc ggt atc acc acc cat atc ggt
tyr gln arg thr ala ala gly trp gln pro leu lys thr gly ile thr thr his ile gly
241/81                                          271/91
tcg gcg ggc atg gcg ccg gaa gcc aag agc gga tat ccg gcc act ccg atg ggg gtt tac
ser ala gly met ala pro glu ala lys ser gly tyr pro ala thr pro met gly val tyr
301/101                                         331/111
agc ctg gac tcc gct ttt ggc acc gcg ccg aat ccc ggt ggc ggg ttg ccg tat acc caa
ser leu asp ser ala phe gly thr ala pro asn pro gly gly gly leu pro tyr thr gln
361/121                                         391/131
gtc gga ccc aat cac tgg tgg agt ggc gac gac aat agc ccc acc ttt aac tcc atg cag
val gly pro asn his trp trp ser gly asp asp asn ser pro thr phe asn ser met gln
421/141                                         451/151
gtc tgt cag aag tcc cag tgc ccg ttc agc acg gcc gac agc gag aac ctg caa atc ccg
val cys gln lys ser gln cys pro phe ser thr ala asp ser glu asn leu gln ile pro
481/161                                         511/171
cag tac aag cat tcg gtc gtg atg ggc gtc aac aag gcc aag gtc cca ggc aaa ggc tcc
gln tyr lys his ser val val met gly val asn lys ala lys val pro gly lys gly ser
541/181                                         571/191
gcg ttc ttc ttt cac acc acc gac ggc ggg ccc acc gcg ggt tgt gtg gcg atc gac gat
ala phe phe phe his thr thr asp gly gly pro thr ala gly cys val ala ile asp asp
601/201                                         631/211
gcc acg ctg gtg cag atc atc cgt tgg ctc cgg cct ggt gcg gtg atc gcg atc gcc aag
ala thr leu val gln ile ile arg trp leu arg pro gly ala val ile ala ile ala lys)
661/221
taa
OCH
```

SEQ ID NOS:769-770

FIG. 44E

Cloned fragment fused with phoA

1/1 SEQ ID NO: 771                                          31/11
gat ctc ccc gga cac cag gtc atc cgg cga gat ggt gat cga ggc tcg gac ccg cag gca
(asp leu pro gly his gln val ile arg arg asp gly asp arg gly ser asp pro gln ala
61/21 SEQ ID NO: 772                                         91/31
tcc ggt agc cag agg cac cag cat cag caa cat cgc gat ggc cag cat gcc gcg ccg tcg
ser gly ser gln arg his gln his gln gln his arg asp gly gln his ala ala pro ser
121/41                                                       151/51
ggt cct tgc cac tcg cga tcc ttg gga tga cgg tgg ggc ata gct agc gcg cac cag gtc
gly pro cys his ser arg ser leu gly)OPA(arg trp gly ile ala ser ala his gln val
181/61              ID NO: 773                               211/71
atc gtg cca gac cgg gca tgc cgc gtc ggc aag ctg tcg ggc gcg ggt tag agc ggt agc
ile val pro asp arg ala cys arg val gly lys leu ser gly ala gly)AMB(ser gly ser
241/81                                                       271/91      SEQ ID NO: 774
gtg cga ccc agg atg gcg aat gct cgg ggg tca ccg gcg aag tgg tag ccg cgg atg atg
val arg pro arg met ala asn ala arg gly ser pro ala lys trp)AMB(pro arg met met
301/101                                                      331/111   SEQ ID NO: 775
tcg gtg aag ccc aac cgg cgg tac aac cgc cac gcc cga ttg tcc tca ccg ttg gtc tcc
ser val lys pro asn arg arg tyr asn arg his ala arg leu ser ser pro leu val ser
361/121                                                      391/131
ggt gtg gag agc agg acg ttg tcc tcg tcg cga ccg gct agc agt cgg cgg gcc aac gcc
gly val glu ser arg thr leu ser ser ser arg pro ala ser ser arg arg ala asn ala
421/141                                                      451/151
tcc ccg agg cca cgg cct tga gcg cgg gga agg atg tgc aat tca gtc aac tcg aag tag
ser pro arg pro arg pro)OPA(ala arg gly arg met cys asn ser val asn ser lys)AMB
481/161      SEQ ID NO: 776                                  511/171
ctg gtc atc agt cgg gcg atc gct agg cgc gga aag ccg ctg cgt tgc aag ccc agt acc
(leu val ile ser arg ala ile ala arg arg gly lys pro leu arg cys lys pro ser thr
541/181 SEQ ID NO: 777                                       571/191
acc tgc tgt tgc cac cac tgg ccg ggc gcc ccg gga tag ccg tac gcc act ccg agc att
thr cys cys cys his his trp pro gly ala pro gly)AMB(pro tyr ala thr pro ser ile
601/201                                                      631/211       SEQ ID NO: 778
ggc gcg ttg ctc agt tcg gcg gcc gac ggc agc gcc gtg gtg tcg gcg gcc tcg gcc tgt
gly ala leu leu ser ser ala ala asp gly ser ala val val ser ala ala ser ala cys
661/221                                                      691/231
tcg gct gcc gtt acc tcg acg gcc gcg acc gcc tgc cag ccg cgc cgc cgg atg tgc tcc
ser ala ala val thr ser thr ala ala thr ala cys gln pro arg arg arg met cys ser
721/241                                                      751/251
agc cac att ggg gcg cgc aaa gtc tcg gtg ccc ctg ggg tag cgc atc gcg tcg aca tac
ser his ile gly ala arg lys val ser val pro leu gly)AMB(arg ile ala ser thr tyr
781/261                                                      811/271      SEQ ID NO: 779
acc gtc agg gca tca ccg agg cgg cgc tcc ata tcg ctg ggc ggc aga tcg atg agg aat
thr val arg ala ser pro arg arg arg ser ile ser leu gly gly arg ser met arg asn
841/281                                                      871/291
atc gcc aac gcg cgg tgt cct cct cat gtg atg aac cga tgc gtg ctt gcg cac cag tat
ile ala asn ala arg cys pro pro his val met asn arg cys val leu ala his gln tyr
901/301                                                      931/311
cgg aca agc cga tga ggc cgc ccg cgc tgg acg ggg ctt gta gcg tat ggc cgt ttc cgc
arg thr ser arg)OPA(gly arg pro arg trp thr gly leu val ala tyr gly arg phe arg
             SEQ ID NO: 780

SEQ ID NOS:771-783

FIG. 45ZA

```
961/321                                         991/331
tca gct cgt cgc tgc ggc gcc gcc ggg ata  gaa tcg ccc gcg aac cag tgg tac ggc gca
ser ala arg arg cys gly ala ala gly ile  glu ser pro ala asn gln trp tyr gly ala
1021/341     SEQ ID NO: 782                     1051/351
gat tga cct cgt atc atc tga gtt agt tgc  ccg cgc aat ggg cat ccg cgt gtt atc ggt
asp)OPA(pro arg ile ile)OPA(val ser cys  pro arg asn gly his pro arg val ile gly
1081/361   SEQ ID NO: 781                       1111/371
att acg tga cag tct gtc ggc aag gag gga  cgc atg cca ctc tcc gat cat gag cag cgg
ile thr)OPA(gln ser val gly lys glu gly  arg met pro leu ser asp his glu gln arg
1141/381        SEQ ID NO: 783                  1171/391
atg ctt gac cag atc gag agc gct ctc tac  gcc gaa gat ccc aag ttc gca tcg agt gtc
met leu asp gln ile glu ser ala leu tyr  ala glu asp pro lys phe ala ser ser val
1201/401                                        1231/411
cgt ggc ggg ggc ttc cgc gca ccg acc gcg  cgg cgg cgc ctg cag ggc gcg gcg ttg ttc
arg gly gly gly phe arg ala pro thr ala  arg arg arg leu gln gly ala ala leu phe
1261/421                                        1291/431
atc atc ggt ctg ggg atg ttg gtt tcc ggc  gtg gcg ttc aaa gag acc atg atc gga agt
ile ile gly leu gly met leu val ser gly  val ala phe lys glu thr met ile gly ser
1321/441                                        1351/451
ttc ccg ata ctc agc gtt ttc ggt ttt gtc  gtg atg ttc ggt ggt gtg gtg tat gcc atc
phe pro ile leu ser val phe gly phe val  val met phe gly gly val val tyr ala ile
1381/461                                        1411/471
acc ggt cct cgg ttg tcc ggc agg atg gat  cgt ggc gga tcg gct gct ggg gct tcg cgc
thr gly pro arg leu ser gly arg met asp  arg gly gly ser ala ala gly ala ser arg
1441/481                                        1471/491
cag cgt cgt acc aag ggg gcc ggg ggc tca  ttc acc agc cgt atg gaa gat c
gln arg arg thr lys gly ala gly gly ser  phe thr ser arg met glu asp)
```

SEQ ID NOS:771-783 (continued)

FIG. 45ZA (continued)

fragment seq45ZA shifted minus 1 for the reading frame

```
1/1  SEQ ID NO: 784                          31/11
atc tcc ccg gac acc agg tca tcc ggc gag atg gtg atc gag gct cgg acc cgc agg cat
(ile ser pro asp thr arg ser ser gly glu met val ile glu ala arg thr arg arg his
61/21  SEQ ID NO: 785                        91/31
ccg gta gcc aga ggc acc agc atc agc aac atc gcg atg gcc agc atg ccg cgc cgt cgg
pro val ala arg gly thr ser ile ser asn ile ala met ala ser met pro arg arg arg
121/41                                       151/51
gtc ctt gcc act cgc gat cct tgg gat gac ggt ggg gca tag cta gcg cgc acc agg tca
val leu ala thr arg asp pro trp asp asp gly gly ala)AMB(leu ala arg thr arg ser
181/61                                       211/71      SEQ ID NO: 786
tcg tgc cag acc ggg cat gcc gcg tcg gca agc tgt cgg gcg cgg gtt aga gcg gta gcg
ser cys gln thr gly his ala ala ser ala ser cys arg ala arg val arg ala val ala
241/81                                       271/91
tgc gac cca gga tgg cga atg ctc ggg ggt cac cgg cga agt ggt agc cgc gga tga tgt
cys asp pro gly trp arg met leu gly gly his arg arg ser gly ser arg gly)OPA cys
301/101                                      331/111
cgg tga agc cca acc ggc ggt aca acc gcc acg ccc gat tgt cct cac cgt tgg tct ccg
arg OPA(ser pro thr gly gly thr thr ala thr pro asp cys pro his arg trp ser pro
361/121  SEQ ID NO: 787                      391/131
gtg tgg aga gca gga cgt tgt cct cgt cgc gac cgg cta gca gtc ggc ggg cca acg cct
val trp arg ala gly arg cys pro arg arg asp arg leu ala val gly gly pro thr pro
421/141                                      451/151
ccc cga ggc cac ggc ctt gag cgc ggg gaa gga tgt gca att cag tca act cga agt agc
pro arg gly his gly leu glu arg gly glu gly cys ala ile gln ser thr arg ser ser
481/161                                      511/171
tgg tca tca gtc ggg cga tcg cta ggc gcg gaa agc cgc tgc gtt gca agc cca gta cca
trp ser ser val gly arg ser leu gly ala glu ser arg cys val ala ser pro val pro
541/181                                      571/191
cct gct gtt gcc acc act ggc cgg gcg ccc cgg gat agc cgt acg cca ctc cga gca ttg
pro ala val ala thr thr gly arg ala pro arg asp ser arg thr pro leu arg ala leu
601/201                                      631/211
gcg cgt tgc tca gtt cgg cgg ccg acg gca gcg ccg tgg tgt cgg cgg cct cgg cct gtt
ala arg cys ser val arg arg pro thr ala ala pro trp cys arg arg pro arg pro val
661/221                                      691/231
cgg ctg ccg tta cct cga cgg ccg cga ccg cct gcc agc cgc gcc gcc gga tgt gct cca
arg leu pro leu pro arg arg pro arg pro pro ala ser arg ala ala gly cys ala pro
721/241                                      751/251
gcc aca ttg ggg cgc gca aag tct cgg tgc ccc tgg ggt agc gca tcg cgt cga cat aca
ala thr leu gly arg ala lys ser arg cys pro trp gly ser ala ser arg arg his thr
781/261                                      811/271
ccg tca ggg cat cac cga ggc ggc gct cca tat cgc tgg gcg gca gat cga tga gga ata
pro ser gly his his arg gly gly ala pro tyr arg trp ala ala asp arg)OPA(gly ile
841/281                                      871/291       SEQ ID NO: 788
tcg cca acg cgc ggt gtc ctc ctc atg tga tga acc gat gcg tgc ttg cgc acc agt atc
ser pro thr arg gly val leu leu met)OPA OPA(thr asp ala cys leu arg thr ser ile
901/301                                      931/311  SEQ ID NO: 789
gga caa gcc gat gag gcc gcc cgc gct gga cgg ggc ttg tag cgt atg gcc gtt tcc gct
gly gln ala asp glu ala ala arg ala gly arg gly leu)AMB(arg met ala val ser ala
961/321                                      991/331      SEQ ID NO: 790
cag ctc gtc gct gcg gcg ccg ccg gga tag aat cgc ccg cga acc agt ggt acg gcg cag
gln leu val ala ala ala pro pro gly)AMB(asn arg pro arg thr ser gly thr ala gln
                                       SEQ ID NO: 791
```

SEQ ID NOS:784-793

FIG. 45ZB

```
1021/341                              1051/351
att gac ctc gta tca tct gag tta gtt gcc cgc gca atg ggc atc cgc gtg tta tcg gta
ile asp leu val ser ser glu leu val ala arg ala met gly ile arg val leu ser val
 1081/361                              1111/371
tta cgt gac agt ctg tcg gca agg agg gac gca tgc cac tct ccg atc atg agc agc gga
leu arg asp ser leu ser ala arg arg asp ala cys his ser pro ile met ser ser gly
1141/381                              1171/391
tgc ttg acc aga tcg aga gcg ctc tct acg ccg aag atc cca agt tcg cat cga gtg tcc
cys leu thr arg ser arg ala leu ser thr pro lys ile pro ser ser his arg val ser
1201/401                              1231/411
gtg gcg ggg gct tcc gcg cac cga ccg cgc ggc ggc gcc tgc agg gcg cgg cgt tgt tca
val ala gly ala ser ala his arg pro arg gly gly ala cys arg ala arg arg cys ser
1261/421                              1291/431
tca tcg gtc tgg gga tgt tgg ttt ccg gcg tgg cgt tca aag aga cca tga tcg gaa gtt
ser ser val trp gly cys trp phe pro ala trp arg ser lys arg pro)OPA(ser glu val
1321/441                              1351/451    SEQ ID NO: 792
tcc cga tac tca gcg ttt tcg gtt ttg tcg tga tgt tcg gtg gtg tgg tgt atg cca tca
ser arg tyr ser ala phe ser val leu ser)OPA(cys ser val val trp cys met pro ser
1381/461                              1411/471   SEQ ID NO: 793
ccg gtc ctc ggt tgt ccg gca gga tgg atc gtg gcg gat cgg ctg ctg ggg ctt cgc gcc
pro val leu gly cys pro ala gly trp ile val ala asp arg leu leu gly leu arg ala
1441/481                              1471/491
agc gtc gta cca agg ggg ccg ggg gct cat tca cca gcc gta tgg aag atc
ser val val pro arg gly pro gly ala his ser pro ala val trp lys ile)
```

SEQ ID NOS:784-793 (continued)

FIG. 45ZB (continued)

fragment seq45ZA shifted minus 2 for the reading frame

```
1/1    SEQ ID NO: 794                          31/11
tct ccc cgg aca cca ggt cat ccg gcg aga   tgg tga tcg agg ctc gga ccc gca ggc atc
(ser pro arg thr pro gly his pro ala arg  trp)OPA(ser arg leu gly pro ala gly ile
61/21     SEQ ID NO: 795                       91/31    SEQ ID NO: 796
cgg tag cca gag gca cca gca tca gca aca   tcg cga tgg cca gca tgc cgc gcc gtc ggg
arg)AMB(pro glu ala pro ala ser ala thr   ser arg trp pro ala cys arg ala val gly
121/41    SEQ ID NO: 797                       151/51
tcc ttg cca ctc gcg atc ctt ggg atg acg   gtg ggg cat agc tag cgc gca cca ggt cat
ser leu pro leu ala ile leu gly met thr   val gly his ser)AMB(arg ala pro gly his
181/61                                         211/71           SEQ ID NO: 798
cgt gcc aga ccg ggc atg ccg cgt cgg caa   gct gtc ggg cgc ggg tta gag cgg tag cgt
arg ala arg pro gly met pro arg arg gln   ala val gly arg gly leu glu arg)AMB(arg
241/81                                         271/91            SEQ ID NO: 799
gcg acc cag gat ggc gaa tgc tcg ggg gtc   acc ggc gaa gtg gta gcc gcg gat gat gtc
ala thr gln asp gly glu cys ser gly val   thr gly glu val val ala ala asp asp val
301/101                                        331/111
ggt gaa gcc caa ccg gcg gta caa ccg cca   cgc ccg att gtc ctc acc gtt ggt ctc cgg
gly glu ala gln pro ala val gln pro pro   arg pro ile val leu thr val gly leu arg
361/121                                        391/131
tgt gga gag cag gac gtt gtc ctc gtc gcg   acc ggc tag cag tcg gcg ggc caa cgc ctc
cys gly glu gln asp val val leu val ala   thr gly)AMB(gln ser ala gly gln arg leu
421/141                                        451/151     SEQ ID NO: 800
ccc gag gcc acg gcc ttg agc gcg ggg aag   gat gtg caa ttc agt caa ctc gaa gta gct
pro glu ala thr ala leu ser ala gly lys   asp val gln phe ser gln leu glu val ala
481/161                                        511/171
ggt cat cag tcg ggc gat cgc tag gcg cgg   aaa gcc gct gcg ttg caa gcc cag tac cac
gly his gln ser gly asp arg)AMB(ala arg   lys ala ala ala leu gln ala gln tyr his
541/181         SEQ ID NO: 801                 571/191
ctg ctg ttg cca cca ctg gcc ggg cgc ccc   ggg ata gcc gta cgc cac tcc gag cat tgg
leu leu leu pro pro leu ala gly arg pro   gly ile ala val arg his ser glu his trp
601/201                                        631/211
cgc gtt gct cag ttc ggc ggc cga cgg cag   cgc cgt ggt gtc ggc ggc ctc ggc ctg ttc
arg val ala gln phe gly gly arg arg gln   arg arg gly val gly gly leu gly leu phe
661/221                                        691/231
ggc tgc cgt tac ctc gac ggc cgc gac cgc   ctg cca gcc gcg ccg ccg gat gtg ctc cag
gly cys arg tyr leu asp gly arg asp arg   leu pro ala ala pro pro asp val leu gln
721/241                                        751/251
cca cat tgg ggc gcg caa agt ctc ggt gcc   cct ggg gta gcg cat cgc gtc gac ata cac
pro his trp gly ala gln ser leu gly ala   pro gly val ala his arg val asp ile his
781/261                                        811/271
cgt cag ggc atc acc gag gcg gcg ctc cat   atc gct ggg cgg cag atc gat gag gaa tat
arg gln gly ile thr glu ala ala leu his   ile ala gly arg gln ile asp glu glu tyr
841/281                                        871/291
cgc caa cgc gcg gtg tcc tcc tca tgt gat   gaa ccg atg cgt gct tgc gca cca gta tcg
arg gln arg ala val ser ser ser cys asp   glu pro met arg ala cys ala pro val ser
901/301                                        931/311
gac aag ccg atg agg ccg ccc gcg ctg gac   ggg gct tgt agc gta tgg ccg ttt ccg ctc
asp lys pro met arg pro pro ala leu asp   gly ala cys ser val trp pro phe pro leu
```

SEQ ID NOS:794-804

FIG. 45ZC

```
961/321                              991/331
agc tcg tcg ctg cgg cgc cgc cgg gat aga atc gcc cgc gaa cca gtg gta cgg cgc aga
ser ser ser leu arg arg arg arg asp arg ile ala arg glu pro val val arg arg arg
1021/341                             1051/351
ttg acc tcg tat cat ctg agt tag ttg ccc gcg caa tgg gca tcc gcg tgt tat cgg tat
leu thr ser tyr his leu ser)AMB(leu pro ala gln trp ala ser ala cys tyr arg tyr
1081/361        SEQ ID NO: 802       1111/371
tac gtg aca gtc tgt cgg caa gga ggg acg cat gcc act ctc cga tca tga gca gcg gat
tyr val thr val cys arg gln gly gly thr his ala thr leu arg ser)OPA(ala ala asp
1141/381                             1171/391     SEQ ID NO: 803
gct tga cca gat cga gag cgc tct cta cgc cga aga tcc caa gtt cgc atc gag tgt ccg
ala)OPA(pro asp arg glu arg ser leu arg arg arg ser gln val arg ile glu cys pro
1201/401    SEQ ID NO: 804           1231/411
tgg cgg ggg ctt ccg cgc acc gac cgc gcg gcg gcg cct gca ggg cgc ggc gtt gtt cat
trp arg gly leu pro arg thr asp arg ala ala ala pro ala gly arg gly val val his
1261/421                             1291/431
cat cgg tct ggg gat gtt ggt ttc cgg cgt ggc gtt caa aga gac cat gat cgg aag ttt
his arg ser gly asp val gly phe arg arg gly val gln arg asp his asp arg lys phe
1321/441                             1351/451
ccc gat act cag cgt ttt cgg ttt tgt cgt gat gtt cgg tgg tgt ggt gta tgc cat cac
pro asp thr gln arg phe arg phe cys arg asp val arg trp cys gly val cys his his
1381/461                             1411/471
cgg tcc tcg gtt gtc cgg cag gat gga tcg tgg cgg atc ggc tgc tgg ggc ttc gcg cca
arg ser ser val val arg gln asp gly ser trp arg ile gly cys trp gly phe ala pro
1441/481                             1471/491
gcg tcg tac caa ggg ggc cgg ggg ctc att cac cag ccg tat gga aga tc
ala ser tyr gln gly gly arg gly leu ile his gln pro tyr gly arg)

SEQ ID NOS:794-804 (continued 1)

FIG. 45ZC (continued 1)

SEQ ID NO: 805
        seq 45ZA joined directly to phoA
cag tct gtc ggc aag gag gga cgc atg cca ctc tcc gat cat gag cag cgg
(gln ser val gly lys glu gly arg met pro leu ser asp his glu gln arg
1141/381   SEQ ID NO: 806            1171/391
atg ctt gac cag atc gag agc gct ctc tac gcc gaa gat ccc aag ttc gca tcg agt gtc
met leu asp gln ile glu ser ala leu tyr ala glu asp pro lys phe ala ser ser val
1201/401                             1231/411
cgt ggc ggg ggc ttc cgc gca ccg acc gcg cgg cgg cgc ctg cag ggc gcg gcg ttg ttc
arg gly gly gly phe arg ala pro thr ala arg arg arg leu gln gly ala ala leu phe
1261/421                             1291/431
atc atc ggt ctg ggg atg ttg gtt tcc ggc gtg gcg ttc aaa gag acc atg atc gga agt
ile ile gly leu gly met leu val ser gly val ala phe lys glu thr met ile gly ser
1321/441                             1351/451
ttc ccg ata ctc agc gtt ttc ggt ttt gtc gtg atg ttc ggt ggt gtg gtg tat gcc atc
phe pro ile leu ser val phe gly phe val val met phe gly gly val val tyr ala ile
1381/461                             1411/471
acc ggt cct cgg ttg tcc ggc agg atg gat cgt ggc gga tcg gct gct ggg gct tcg cgc
thr gly pro arg leu ser gly arg met asp arg gly gly ser ala ala gly ala ser arg
1441/481                             1471/491
cag cgt cgt acc aag ggg gcc ggg ggc tca ttc acc agc cgt atg gaa gat c
gln arg arg thr lys gly ala gly gly ser phe thr ser arg met glu asp)

SEQ ID NOS:805-806

FIG. 45A
```

Sequence Rv2169c predicted by Cole et al., 1998 (Nature 393:537-544)
and containing Seq45A

```
1/1   SEQ ID NO: 807                    31/11
atg cca ctc tcc gat cat gag cag cgg atg ctt gac cag atc gag agc gct ctc tac gcc
(Met pro leu ser asp his glu gln arg met leu asp gln ile glu ser ala leu tyr ala
61/21   SEQ ID NO: 808                  91/31
gaa gat ccc aag ttc gca tcg agt gtc cgt ggc ggg ggc ttc cgc gca ccg acc gcg cgg
glu asp pro lys phe ala ser ser val arg gly gly gly phe arg ala pro thr ala arg
121/41                                  151/51
cgg cgc ctg cag ggc gcg gcg ttg ttc atc atc ggt ctg ggg atg ttg gtt tcc ggc gtg
arg arg leu gln gly ala ala leu phe ile ile gly leu gly met leu val ser gly val
181/61                                  211/71
gcg ttc aaa gag acc atg atc gga agt ttc ccg ata ctc agc gtt ttc ggt ttt gtc gtg
ala phe lys glu thr met ile gly ser phe pro ile leu ser val phe gly phe val val
241/81                                  271/91
atg ttc ggt ggt gtg gtg tat gcc atc acc ggt cct cgg ttg tcc ggc agg atg gat cgt
met phe gly gly val val tyr ala ile thr gly pro arg leu ser gly arg met asp arg
301/101                                 331/111
ggc gga tcg gct gct ggg gct tcg cgc cag cgt cgt acc aag ggg gcc ggg ggc tca ttc
gly gly ser ala ala gly ala ser arg gln arg arg thr lys gly ala gly gly ser phe
361/121                                 391/131
acc agc cgt atg gaa gat cgg ttc cgg cgc cgc ttc gac gag taa
thr ser arg met glu asp arg phe arg arg arg phe asp glu)OCH
```

SEQ ID NOS: 807-808

FIG. 45D

ORF according to Cole et al., 1998 (Nature 393:537-544) and containing Rv2169c

```
1/1   SEQ ID NO: 809                    31/11
tga cag tct gtc ggc aag gag gga cgc atg cca ctc tcc gat cat gag cag cgg atg ctt
OPA(gln ser val gly lys glu gly arg met pro leu ser asp his glu gln arg met leu
61/21   SEQ ID NO: 810                  91/31
gac cag atc gag agc gct ctc tac gcc gaa gat ccc aag ttc gca tcg agt gtc cgt ggc
asp gln ile glu ser ala leu tyr ala glu asp pro lys phe ala ser ser val arg gly
121/41                                  151/51
ggg ggc ttc cgc gca ccg acc gcg cgg cgg cgc ctg cag ggc gcg gcg ttg ttc atc atc
gly gly phe arg ala pro thr ala arg arg arg leu gln gly ala ala leu phe ile ile
181/61                                  211/71
ggt ctg ggg atg ttg gtt tcc ggc gtg gcg ttc aaa gag acc atg atc gga agt ttc ccg
gly leu gly met leu val ser gly val ala phe lys glu thr met ile gly ser phe pro
241/81                                  271/91
ata ctc agc gtt ttc ggt ttt gtc gtg atg ttc ggt ggt gtg gtg tat gcc atc acc ggt
ile leu ser val phe gly phe val val met phe gly gly val val tyr ala ile thr gly
301/101                                 331/111
cct cgg ttg tcc ggc agg atg gat cgt ggc gga tcg gct gct ggg gct tcg cgc cag cgt
pro arg leu ser gly arg met asp arg gly gly ser ala ala gly ala ser arg gln arg
361/121                                 391/131
cgt acc aag ggg gcc ggg ggc tca ttc acc agc cgt atg gaa gat cgg ttc cgg cgc cgc
arg thr lys gly ala gly gly ser phe thr ser arg met glu asp arg phe arg arg arg
421/141
ttc gac gag taa
phe asp glu)OCH
```

SEQ ID No:809-810

FIG. 45E

```
1/1   SEQ ID NO: 811                          31/11
cag ccg cgc cgc atc gac cag ggc ctc acg  ccc ggt cac ttc tcc gcg ttc ctc aac aat
(gln pro arg arg ile asp gln gly leu thr  pro gly his phe ser ala phe leu asn asn
61/21   SEQ ID NO: 812                        91/31
tcc ggt gaa cat cgc acc agg tta ggc agc  aat ccc gcg gac ccg cac ccc act cgc cga
ser gly glu his arg thr arg leu gly ser  asn pro ala asp pro his pro thr arg arg
121/41                                        151/51
ccg gcc aac tca cag aca ccc tct acg atg  cag ggt atg cgg acc ccc aga cgc cac tgc
pro ala asn ser gln thr pro ser thr met  gln gly met arg thr pro arg arg his cys
181/61                                        211/71
cgt cgc atc gcc gtc ctc gcc gcc gtt agc  atc gcc gcc act gtc gtt gcc ggc tgc tcg
arg arg ile ala val leu ala ala val ser  ile ala ala thr val val ala gly cys ser
241/81                                        271/91
tcg ggc tcg aag cca agc ggc gga cca ctt  ccg gac gcg aag ccg ctg gtc gag gag gcc
ser gly ser lys pro ser gly gly pro leu  pro asp ala lys pro leu val glu glu ala
301/101                                       331/111
acc gcg cag acc aag gct ctc aag agc gcg  cac atg gtg ctg acg gtc aac ggc aag atc
thr ala gln thr lys ala leu lys ser ala  his met val leu thr val asn gly lys ile)

SEQ ID NOS:811-812

FIG. 46A

1/1  SEQ ID NO: 813                           31/11
agc cgc gcc gca tcg acc agg gcc tca cgc  ccg gtc act tct ccg cgt tcc tca aca att
(ser arg ala ala ser thr arg ala ser arg  pro val thr ser pro arg ser ser thr ile
61/21   SEQ ID NO: 814                        91/31
ccg gtg aac atc gca cca ggt tag gca gca  atc ccg cgg acc cgc acc cca ctc gcc gac
pro val asn ile ala pro gly)AMB(ala ala  ile pro arg thr arg thr pro leu ala asp
121/41            SEQ ID NO: 815              151/51
cgg cca act cac aga cac cct cta cga tgc  agg gta tgc gga ccc cag acg cca ctg cc
arg pro thr his arg his pro leu arg cys  arg val cys gly pro pro asp ala thr ala
181/61                                        211/71
gtc gca tcg ccg tcc tcg ccg ccg tta gca  tcg ccg cca ctg tcg ttg ccg gct gct cgt
val ala ser pro ser ser pro pro leu ala  ser pro pro leu ser leu pro ala ala arg
241/81                                        271/91
cgg gct cga agc caa gcg gcg gac cac ttc  cgg acg cga agc cgc tgg tcg agg agg cca
arg ala arg ser gln ala ala asp his phe  arg thr arg ser arg trp ser arg arg pro
301/101                                       331/111
ccg cgc aga cca agg ctc tca aga gcg cgc  aca tgg tgc tga cgg tca acg gca aga tc
pro arg arg pro arg leu ser arg ala arg  thr trp cys)OPA(arg ser thr ala arg)
                                                          SEQ ID NO: 816

SEQ ID NOS:813-816

FIG. 46B
```

```
1/1   SEQ ID NO: 817                        31/11
gcc gcg ccg cat cga cca ggg cct cac gcc cgg tca ctt ctc cgc gtt cct caa caa ttc
(ala ala pro his arg pro gly pro his ala arg ser leu leu arg val pro gln gln phe
61/21    SEQ ID NO: 818                     91/31
cgg tga aca tcg cac cag gtt agg cag caa tcc cgc gga ccc gca ccc cac tcg ccg acc
arg)OPA(thr ser his gln val arg gln gln ser arg gly pro ala pro his ser pro thr
121/41        SEQ ID NO: 819                151/51
ggc caa ctc aca gac acc ctc tac gat gca ggg tat gcg gac ccc cag acg cca ctg ccg
gly gln leu thr asp thr leu tyr asp ala gly tyr ala asp pro gln thr pro leu pro
181/61                                      211/71
tcg cat cgc cgt cct cgc cgc cgt tag cat cgc cgc cac tgt cgt tgc cgg ctg ctc gtc
ser his arg arg pro arg arg arg)AMB(his arg arg his cys arg cys arg leu leu val
241/81             SEQ ID NO: 820            271/91
ggg ctc gaa gcc aag cgg cgg acc act tcc gga cgc gaa gcc gct ggt cga gga ggc cac
gly leu glu ala lys arg arg thr thr ser gly arg glu ala ala gly arg gly gly his
301/101                                     331/111
cgc gca gac caa ggc tct caa gag cgc gca cat ggt gct gac ggt caa cgg caa gat c
arg ala asp gln gly ser gln glu arg ala his gly ala asp gly gln arg gln asp)
```

SEQ ID NOS:817-820

FIG. 46C

Coding sequence Rv1411c predicted by Cole et al., 1998 (Nature 393: 537-544) and containing seq46A:

```
1/1     SEQ ID NO: 821                    31/11
atg cgg acc ccc aga cgc cac tgc cgt cgc atc gcc gtc ctc gcc gcc gtt agc atc gcc
(Met arg thr pro arg arg his cys arg arg ile ala val leu ala ala val ser ile ala
61/21     SEQ ID NO: 822                  91/31
gcc act gtc gtt gcc ggc tgc tcg tcg ggc tcg aag cca agc ggc gga cca ctt ccg gac
ala thr val val ala gly cys ser ser gly ser lys pro ser gly gly pro leu pro asp
121/41                                    151/51
gcg aag ccg ctg gtc gag gag gcc acc gcg cag acc aag gct ctc aag agc gcg cac atg
ala lys pro leu val glu glu ala thr ala gln thr lys ala leu lys ser ala his met
181/61                                    211/71
gtg ctg acg tcc aac ggc aag atc ccg gga ctg tct ctg aag acg ctg agc ggc gat ctc
val leu thr val asn gly lys ile pro gly leu ser leu lys thr leu ser gly asp leu
241/81                                    271/91
acc acc aac ccc acc gcc gcg acg gga aac gtc aag ctc acg ctg ggt ggg tct gat atc
thr thr asn pro thr ala ala thr gly asn val lys leu thr leu gly gly ser asp ile
301/101                                   331/111
gat gcc gac ttc gtg gtg ttc gac ggg atc ctg tac gcc acc ctg acg ccc aac cag tgg
asp ala asp phe val val phe asp gly ile leu tyr ala thr leu thr pro asn gln trp
361/121                                   391/131
agc gat ttc ggt ccc gcc gcc gac atc tac gac ccc gcc cag gtg ctg aat ccg gat acc
ser asp phe gly pro ala ala asp ile tyr asp pro ala gln val leu asn pro asp thr
421/141                                   451/151
ggc ctg gcc aac gtg ctg gcg aat ttc gcc gac gca aaa gcc gaa ggg cgg gat acc atc
gly leu ala asn val leu ala asn phe ala asp ala lys ala glu gly arg asp thr ile
481/161                                   511/171
aac ggc cag aac acc atc cgc atc agc ggg aag gta tcg gca cag gcg gtg aac cag ata
asn gly gln asn thr ile arg ile ser gly lys val ser ala gln ala val asn gln ile
541/181                                   571/191
gcg ccg ccg ttc aac gcg acg cag ccg gtg ccg gcg acc gtc tgg att cag gag acc ggc
ala pro pro phe asn ala thr gln pro val pro ala thr val trp ile gln glu thr gly
601/201                                   631/211
gat cat caa ctg gca cag gcc cag ttg gac cgc ggc tcg ggc aat tcc gtc cag atg acc
asp his gln leu ala gln ala gln leu asp arg gly ser gly asn ser val gln met thr
661/221                                   691/231
ttg tcg aaa tgg ggc gag aag gtc cag gtc acg aag ccc ccg gtg agc tga
leu ser lys trp gly glu lys val gln val thr lys pro pro val ser)OPA
```

SEQ ID NOS:821-822

FIG. 46D

ORF according to Cole et al., 1998 (Nature 393: 537-544):
and containing the coding sequence Rv1411c:

```
1/1    SEQ ID NO: 823                   31/11
tag ctc acc cag gtt gga ccg gtt cag tgt ctc ggc cat cac gtc ggc ggt gaa ttg gcc
AMB(leu thr gln val gly pro val gln cys leu gly his his val gly gly glu leu ala
61/21   SEQ ID NO: 824                  91/31
gtc ggg caa tac atc gac gac cgt cag aca cac gcc gtt gac agc gat cga gtc gcc gtg
val gly gln tyr ile asp asp arg gln thr his ala val asp ser asp arg val ala val
121/41                                  151/51
gcc ggc gtc ggc ggt aac cat cgg acc gcg gat ggt cag ccg cgc cgc atc gac cag ggc
ala gly val gly gly asn his arg thr ala asp gly gln pro arg arg ile asp gln gly
181/61                                  211/71
ctc acg ccc ggt cac ttc tcc gcg ttc ctc aac aat tcc ggt gaa cat cgc acc agg tta
leu thr pro gly his phe ser ala phe leu asn asn ser gly glu his arg thr arg leu
241/81                                  271/91
ggc agc aat ccc gcg gac ccg cac ccc act cgc cga ccg gcc aac tca cag aca ccc tct
gly ser asn pro ala asp pro his pro thr arg arg pro ala asn ser gln thr pro ser
301/101                                 331/111
acg atg cag ggt atg cgg acc ccc aga cgc cac tgc cgt cgc atc gcc gtc ctc gcc gcc
thr met gln gly met arg thr pro arg arg his cys arg arg ile ala val leu ala ala
361/121                                 391/131
gtt agc atc gcc gcc act gtc gtt gcc ggc tgc tcg tcg ggc tcg aag cca agc ggc gga
val ser ile ala ala thr val val ala gly cys ser ser gly ser lys pro ser gly gly
421/141                                 451/151
cca ctt ccg gac gcg aag ccg ctg gtc gag gag gcc acc gcg cag acc aag gct ctc aag
pro leu pro asp ala lys pro leu val glu glu ala thr ala gln thr lys ala leu lys
481/161                                 511/171
agc gcg cac atg gtg ctg acg gtc aac ggc aag atc ccg gga ctg tct ctg aag acg ctg
ser ala his met val leu thr val asn gly lys ile pro gly leu ser leu lys thr leu
541/181                                 571/191
agc ggc gat ctc acc acc aac ccc acc gcc gcg acg gga aac gtc aag ctc acg ctg ggt
ser gly asp leu thr thr asn pro thr ala ala thr gly asn val lys leu thr leu gly
601/201                                 631/211
ggg tct gat atc gat gcc gac ttc gtg gtg ttc gac ggg atc ctg tac gcc acc ctg acg
gly ser asp ile asp ala asp phe val val phe asp gly ile leu tyr ala thr leu thr
661/221                                 691/231
ccc aac cag tgg agc gat ttc ggt ccc gcc gcc gac atc tac gac ccc gcc cag gtg ctg
pro asn gln trp ser asp phe gly pro ala ala asp ile tyr asp pro ala gln val leu
721/241                                 751/251
aat ccg gat acc ggc ctg gcc aac gtg ctg gcg aat ttc gcc gac gca aaa gcc gaa ggg
asn pro asp thr gly leu ala asn val leu ala asn phe ala asp ala lys ala glu gly
781/261                                 811/271
cgg gat acc atc aac ggc cag aac acc atc cgc atc agc ggg aag gta tcg gca cag gcg
arg asp thr ile asn gly gln asn thr ile arg ile ser gly lys val ser ala gln ala
841/281                                 871/291
gtg aac cag ata gcg ccg ccg ttc aac gcg acg cag ccg gtg ccg gcg acc gtc tgg att
val asn gln ile ala pro pro phe asn ala thr gln pro val pro ala thr val trp ile
901/301                                 931/311
cag gag acc ggc gat cat caa ctg gca cag gcc cag ttg gac cgc ggc tcg ggc aat tcc
gln glu thr gly asp his gln leu ala gln ala gln leu asp arg gly ser gly asn ser
961/321                                 991/331
gtc cag atg acc ttg tcg aaa tgg ggc gag aag gtc cag gtc acg aag ccc ccg gtg agc
val gln met thr leu ser lys trp gly glu lys val gln val thr lys pro pro val ser)
1021/341
tga
OPA
```

SEQ ID NOS:823-824

FIG. 46E

1/1 SEQ ID NO: 825                                31/11
gag ctg gtc aac ggc gcc ggc atc gac gac gcc gcc gtc gtg acc tgc cgg ccg gac agc
(glu leu val asn gly ala gly ile asp asp ala ala val val thr cys arg pro asp ser
61/21 SEQ ID NO: 826                              91/31
ctg gcc gat gcc cag cag atg gtc gag gcg gca ctg ggc cga tat ggc cgt ttg gac gga
leu ala asp ala gln gln met val glu ala ala leu gly arg tyr gly arg leu asp gly
121/41                                            151/51
gtg ttg gtg gcc tcg ggc agc aac cat gtg gcg ccc att acc gag atg gcc gtc gag gac
val leu val ala ser gly ser asn his val ala pro ile thr glu met ala val glu asp
181/61                                            211/71
ttc gac gct gtg atg gac gcg aac gtg cgg ggt gcc tgg ctg gtg tgt cgg gcg gcc gga
phe asp ala val met asp ala asn val arg gly ala trp leu val cys arg ala ala gly
241/81                                            271/91
cgg gtg ctg ctc gag cag ggt cag ggc ggc agc gtg gtg ctg gtg tcg tcc gtt cgc ggc
arg val leu leu glu gln gly gln gly gly ser val val leu val ser ser val arg gly
301/101                                           331/111
ggg ttg ggc aat gcc gcc ggt tac agc gcg tac tgc ccg tcg aag gcg ggc acc gat c
gly leu gly asn ala ala gly tyr ser ala tyr cys pro ser lys ala gly thr asp)

SEQ ID NOS: 825-826

FIG. 47A

1/1 SEQ ID NO: 827                                31/11
agc tgg tca acg gcg ccg gca tcg acg acg ccg ccg tcg tga cct gcc ggc cgg aca gcc
(ser trp ser thr ala pro ala ser thr thr pro pro ser)OPA(pro ala gly arg thr ala
61/21 SEQ ID NO: 828                              91/31       SEQ ID NO: 829
tgg ccg atg ccc agc aga tgg tcg agg cgg cac tgg ccg atg gcc gtt tgg acg gag
trp pro met pro ser arg trp ser arg arg his trp ala asp met ala val trp thr glu
121/41                                            151/51
tgt tgg tgg cct cgg gca gca acc atg tgg cgc cca tta ccg aga tgg ccg tcg agg act
cys trp trp pro arg ala ala thr met trp arg pro leu pro arg trp pro ser arg thr
181/61                                            211/71
tcg acg ctg tga tgg acg cga acg tgc ggg gtg cct ggc tgg tgt gtc ggg cgg ccg gac
ser thr leu)OPA(trp thr arg thr cys gly val pro gly trp cys val gly arg pro asp
241/81        SEQ ID NO: 830                      271/91
ggg tgc tgc tcg agc agg gtc agg gcg gca gcg tgg tgc tgg tgt cgt ccg ttc gcg gcg
gly cys cys ser ser arg val arg ala ala ala trp cys trp cys arg pro phe ala ala
301/101                                           331/111
ggt tgg gca atg ccg ccg gtt aca gcg cgt act gcc cgt cga agg cgg cac cga tc
gly trp ala met pro pro val thr ala arg thr ala arg arg arg arg ala pro ile)

SEQ ID NOS: 827-830

FIG. 47B

1/1 SEQ ID NO: 831                          31/11
gct ggt caa cgg cgc cgg cat cga cga cgc cgc cgt cgt gac ctg ccg gcc gga cag cct
(ala gly gln arg arg arg his arg arg arg arg arg arg asp leu pro ala gly gln pro
61/21      SEQ ID NO: 832                   91/31
ggc cga tgc cca gca gat ggt cga ggc ggc act ggg ccg ata tgg ccg ttt gga cgg agt
gly arg cys pro ala asp gly arg gly gly thr gly pro ile trp pro phe gly arg ser
121/41                                      151/51
gtt ggt ggc ctc ggg cag caa cca tgt ggc gcc cat tac cga gat ggc cgt cga gga ctt
val gly gly leu gly gln gln pro cys gly ala his tyr arg asp gly arg arg gly leu
181/61                                      211/71
cga cgc tgt gat gga cgc gaa cgt gcg ggg tgc ctg gct ggt gtg tcg ggc ggc cgg acg
arg arg cys asp gly arg glu arg ala gly cys leu ala gly val ser gly gly arg thr
241/81                                      271/91
ggt gct gct cga gca ggg tca ggg cgg cag cgt ggt gct ggt gtc gtc cgt tcg cgg cgg
gly ala ala arg ala gly ser gly arg gln arg gly ala gly val val arg ser arg arg
301/101                                     331/111
gtt ggg caa tgc cgc cgg tta cag cgc gta ctg ccc gtc gaa ggc ggg cac cga tc
val gly gln cys arg arg leu gln arg val leu pro val glu gly gly his arg)

SEQ ID NOS:831-832

FIG. 47C

Coding sequence Rv1714 predicted by Cole et al., 1998 (Nature 393: 537-544) and containing seq 47A:

```
1/1    SEQ ID NO: 833                        31/11
gtg gag gaa atg gcg ctg gct cag cag gtg ccg aac ctg ggt ctg gcg cgc ttc agc gtg
(val glu glu met ala leu ala gln gln val pro asn leu gly leu ala arg phe ser val
61/21   SEQ ID NO: 834                        91/31
cag gac aag tcg atc ctg atc acc ggc gcg acc ggt tcg ttg ggc cga gtt gcc gcc cgg
gln asp lys ser ile leu ile thr gly ala thr gly ser leu gly arg val ala ala arg
121/41                                       151/51
gcg ctg gcc gac gcg gga gcg cgg ctg aca ctg gcc ggc ggc aac tcg gcc ggt ctg gcc
ala leu ala asp ala gly ala arg leu thr leu ala gly gly asn ser ala gly leu ala
181/61                                       211/71
gag ctg gtc aac ggc gcc ggc atc gac gac gcc gcc gtc gtg acc tgc cgg ccg gac agc
glu leu val asn gly ala gly ile asp asp ala ala val val thr cys arg pro asp ser
241/81                                       271/91
ctg gcc gat gcc cag cag atg gtc gag gcg gca ctg ggc cga tat ggc cgt ttg gac gga
leu ala asp ala gln gln met val glu ala ala leu gly arg tyr gly arg leu asp gly
301/101                                      331/111
gtg ttg gtg gcc tcg ggc agc aac cat gtg gcg ccc att acc gag atg gcc gtc gag gac
val leu val ala ser gly ser asn his val ala pro ile thr glu met ala val glu asp
361/121                                      391/131
ttc gac gct gtg atg gac gcg aac gtg cgg ggt gcc tgg ctg gtg tgt cgg gcg gcc gga
phe asp ala val met asp ala asn val arg gly ala trp leu val cys arg ala ala gly
421/141                                      451/151
cgg gtg ctg ctc gag cag ggt cag ggc ggc agc gtg gtg ctg gtg tcg tcc gtt cgc ggc
arg val leu leu glu gln gly gln gly gly ser val val leu val ser ser val arg gly
481/161                                      511/171
ggg ttg ggc aat gcc gcc ggt tac agc gcg tac tgc ccg tcg aag gcg ggc acc gat ctg
gly leu gly asn ala ala gly tyr ser ala tyr cys pro ser lys ala gly thr asp leu
541/181                                      571/191
ttg gcc aag aca ttg gcg gcc gaa tgg ggc ggt cac ggc att cgg gtg aac gcg ctg gcg
leu ala lys thr leu ala ala glu trp gly gly his gly ile arg val asn ala leu ala
601/201                                      631/211
ccg acg gtg ttt cgg tcc gcg gtg acc gag tgg atg ttc acc gac gat ccg aag ggc cgg
pro thr val phe arg ser ala val thr glu trp met phe thr asp asp pro lys gly arg
661/221                                      691/231
gcc acc cgg gag gcg atg ctc gcc cgg atc ccg ttg cgc cgc ttc gcc gaa ccg gaa gac
ala thr arg glu ala met leu ala arg ile pro leu arg arg phe ala glu pro glu asp
721/241                                      751/251
ttc gtc ggc gcc ctg atc tat ctg ctc agc gac gcc tcg agc ttc tac acc ggc cag gtg
phe val gly ala leu ile tyr leu leu ser asp ala ser ser phe tyr thr gly gln val
781/261                                      811/271
atg tat ctg gac ggc ggg tac acc gca tgc tga
met tyr leu asp gly gly tyr thr ala cys)OPA
```

SEQ ID NOS:833-834

FIG. 47D

ORF according to Cole et al., 1998 (Nature 393: 537-544) and containing the coding sequence Rv1714:

24/1 SEQ ID NO: 835  54/11
tag gtg gag gaa atg gcg ctg gct cag cag gtg ccg aac ctg ggt ctg gcg cgc ttc agc
AMB(val glu glu met ala leu ala gln gln val pro asn leu gly leu ala arg phe ser
84/21 SEQ ID NO: 836  114/31
gtg cag gac aag tcg atc ctg atc acc ggc gcg acc ggt tcg ttg ggc cga gtt gcc gcc
val gln asp lys ser ile leu ile thr gly ala thr gly ser leu gly arg val ala ala
144/41  174/51
cgg gcg ctg gcc gac gcg gga gcg cgg ctg aca ctg gcc ggc ggc aac tcg gcc ggt ctg
arg ala leu ala asp ala gly ala arg leu thr leu ala gly gly asn ser ala gly leu
204/61  234/71
gcc gag ctg gtc aac ggc gcc ggc atc gac gac gcc gcc gtc gtg acc tgc cgg ccg gac
ala glu leu val asn gly ala gly ile asp asp ala ala val val thr cys arg pro asp
264/81  294/91
agc ctg gcc gat gcc cag cag atg gtc gag gcg gca ctg ggc cga tat ggc cgt ttg gac
ser leu ala asp ala gln gln met val glu ala ala leu gly arg tyr gly arg leu asp
324/101  354/111
gga gtg ttg gtg gcc tcg ggc agc aac cat gtg gcg ccc att acc gag atg gcc gtc gag
gly val leu val ala ser gly ser asn his val ala pro ile thr glu met ala val glu
384/121  414/131
gac ttc gac gct gtg atg gac gcg aac gtg cgg ggt gcc tgg ctg gtg tgt cgg gcg gcc
asp phe asp ala val met asp ala asn val arg gly ala trp leu val cys arg ala ala
444/141  474/151
gga cgg gtg ctg ctc gag cag ggt cag ggc ggc agc gtg gtg ctg gtg tcg tcc gtt cgc
gly arg val leu leu glu gln gly gln gly gly ser val val leu val ser ser val arg
504/161  534/171
ggc ggg ttg ggc aat gcc gcc ggt tac agc gcg tac tgc ccg tcg aag gcg ggc acc gat
gly gly leu gly asn ala ala gly tyr ser ala tyr cys pro ser lys ala gly thr asp
564/181  594/191
ctg ttg gcc aag aca ttg gcg gcc gaa tgg ggc ggt cac ggc att cgg gtg aac gcg ctg
leu leu ala lys thr leu ala ala glu trp gly gly his gly ile arg val asn ala leu
624/201  654/211
gcg ccg acg gtg ttt cgg tcc gcg gtg acc gag tgg atg ttc acc gac gat ccg aag ggc
ala pro thr val phe arg ser ala val thr glu trp met phe thr asp asp pro lys gly
684/221  714/231
cgg gcc acc cgg gag gcg atg ctc gcc cgg atc ccg ttg cgc cgc ttc gcc gaa ccg gaa
arg ala thr arg glu ala met leu ala arg ile pro leu arg arg phe ala glu pro glu
744/241  774/251
gac ttc gtc ggc gcc ctg atc tat ctg ctc agc gac gcc tcg agc ttc tac acc ggc cag
asp phe val gly ala leu ile tyr leu leu ser asp ala ser ser phe tyr thr gly gln
804/261  834/271
gtg atg tat ctg gac ggc ggg tac acc gca tgc tga
val met tyr leu asp gly gly tyr thr ala cys)OPA

SEQ ID NOS:835-836

FIG. 47E

1/1 SEQ ID NO: 837                          31/11
agg ctc atg agc aag acg gtt ctc atc ctt ggc gcg ggt gtc ggc ggc ctg acc acc gcc
(arg leu met ser lys thr val leu ile leu gly ala gly val gly gly leu thr thr ala
61/21 SEQ ID NO: 838                        91/31
gac acc ctc cgt caa ctg cta cca cct gag gat c
asp thr leu arg gln leu leu pro pro glu asp)

SEQ ID NOS:837-838

FIG. 48A

1/1 SEQ ID NO: 839                          31/11
ggc tca tga gca aga cgg ttc tca tcc ttg gcg cgg gtg tcg gcg gcc tga cca ccg ccg
gly ser OPA(ala arg arg phe ser ser leu ala arg val ser ala ala)OPA(pro pro pro
61/21     SEQ ID NO: 840                    91/31      SEQ ID NO: 841
aca ccc tcc gtc aac tgc tac cac ctg agg atc
thr pro ser val asn cys tyr his leu arg ile)

SEQ ID NOS:839-841

FIG. 48B

1/1 SEQ ID NO: 842                          31/11
gct cat gag caa gac ggt tct cat cct tgg cgc ggg tgt cgg cgg cct gac cac cgc cga
(ala his glu gln asp gly ser his pro trp arg gly cys arg arg pro asp his arg arg
61/21 SEQ ID NO: 843
cac cct ccg tca act gct acc acc tga gga tc
his pro pro ser thr ala thr thr)OPA gly

SEQ ID NOS:842-843

FIG. 48C

Coding sequence Rv0331 predicted by Cole et al., 1998 (Nature 393: 537-544) and containing seq48A:

```
1/1   SEQ ID NO: 844                          31/11
atg agc aag acg gtt ctc atc ctt ggc gcg ggt gtc ggc ggc ctg acc acc gcc gac acc
(Met ser lys thr val leu ile leu gly ala gly val gly gly leu thr thr ala asp thr
61/21    SEQ ID NO: 845                        91/31
ctc cgt caa ctg cta cca cct gag gat cga atc ata ttg gtg gac agg agc ttt gac ggg
leu arg gln leu leu pro pro glu asp arg ile ile leu val asp arg ser phe asp gly
121/41                                         151/51
acg ctg ggc ttg tcg ttg cta tgg gtg ttg cgg ggc tgg cgg cgg cct gac gac gtc cgc
thr leu gly leu ser leu leu trp val leu arg gly trp arg arg pro asp asp val arg
181/61                                         211/71
gtc cgc ccc acc gcg gcg tcg ctg ccc ggt gtg gaa atg gtt act gca acc gtc gcc cac
val arg pro thr ala ala ser leu pro gly val glu met val thr ala thr val ala his
241/81                                         271/91
att gac atc gcg gcc cag gta gtg cac acc gac aac agc gtc atc ggc tat gac gcg ttg
ile asp ile ala ala gln val val his thr asp asn ser val ile gly tyr asp ala leu
301/101                                        331/111
gtg atc gca tta ggt gcg gcg ctg aac acc gac gcc gtt ccc gga ctg tcg gac gcg ctc
val ile ala leu gly ala ala leu asn thr asp ala val pro gly leu ser asp ala leu
361/121                                        391/131
gac gcc gac gtc gcg ggc cag ttc tac acc ctg gac ggc gcg gct gag ctg cgt gcg aag
asp ala asp val ala gly gln phe tyr thr leu asp gly ala ala glu leu arg ala lys
421/141                                        451/151
gtc gag gcg ctc gag cat ggc cgg atc gct gtg gct atc gcc ggg gtg ccg ttc aaa tgc
val glu ala leu glu his gly arg ile ala val ala ile ala gly val pro phe lys cys
481/161                                        511/171
cca gcc gca ccg ttc gaa gcg gcg ttt ctg atc gcc gcc caa ctc ggt gac cgc tac gcc
pro ala ala pro phe glu ala ala phe leu ile ala ala gln leu gly asp arg tyr ala
541/181                                        571/191
acc gga acc gta cag atc gac acg ttc acg cct gac ccg ctg ccg atg ccc gtt gca ggt
thr gly thr val gln ile asp thr phe thr pro asp pro leu pro met pro val ala gly
601/201                                        631/211
ccc gag gtc ggc gag gct ttg gtc tcg atg ctc aag gat cac ggt gtc ggc ttc cat cct
pro glu val gly glu ala leu val ser met leu lys asp his gly val gly phe his pro
661/221                                        691/231
cgc aag gcc cta gct cgc gtc gat gag gcc gca agg acg atg cac ttc ggt gac ggc acg
arg lys ala leu ala arg val asp glu ala ala arg thr met his phe gly asp gly thr
721/241                                        751/251
tcc gaa ccg ttc gat ctg ctt gcc gtg gtc ccc ccg cac gtg ccc tcc gcc gcg gcg cgg
ser glu pro phe asp leu leu ala val val pro pro his val pro ser ala ala ala arg
781/261                                        811/271
tca gcg ggt ctc agc gaa tcc ggg tgg ata ccc gtg gac ccg cgc acc ctg tcc act agc
ser ala gly leu ser glu ser gly trp ile pro val asp pro arg thr leu ser thr ser
841/281                                        871/291
gcc gac aac gtg tgg gcc atc ggc gat gcg acc gtg ctg acg ctg ccg aat ggc aaa ccg
ala asp asn val trp ala ile gly asp ala thr val leu thr leu pro asn gly lys pro
901/301                                        931/311
ctg ccc aag gct gcc gtg ttc gcc gaa gcc cag gcc gca gtt gtc gcc cac ggc gtc gcc
leu pro lys ala ala val phe ala glu ala gln ala ala val val ala his gly val ala
961/321                                        991/331
cgc cat ctc ggt tac gac gta gct gag cgc cac ttc acc ggc acg ggc gcc tgc tac gtc
arg his leu gly tyr asp val ala glu arg his phe thr gly thr gly ala cys tyr val
1021/341                                       1051/351
gag acc ggt gat cac cag gca gcc aag ggc gac ggc gat ttc ttc gct ccg tcg gcg ccc
glu thr gly asp his gln ala ala lys gly asp gly asp phe phe ala pro ser ala pro
1081/361                                       1111/371
tcg gtg acg ctg tac ccg ccg tcg cgg gag ttt cac gag gag aag gtc gca caa gaa ctg
ser val thr leu tyr pro pro ser arg glu phe his glu glu lys val ala gln glu leu
1141/381
gcc tgg ctg acc cgc tgg aag acg tga
ala trp leu thr arg trp lys thr)OPA
```

SEQ ID NOS:844-845

FIG. 48D

ORF according to Cole et al., 1998 (Nature 393: 537-544) and containing coding sequence Rv0331:

```
1/1   SEQ ID NO: 846                        31/11
tga aca ccc gcg ccg acg cgg cga caa tcg cgg aaa acc ggt ccg cgg gaa tgc tgc ggg
OPA(thr pro ala pro thr arg arg gln ser arg lys thr gly pro arg glu cys cys gly
61/21    SEQ ID NO: 847                     91/31
cca tgg gcc gat aat agt ttg act gac tcg gtc agt cac ccc aag acc ttg cgc aag act
pro trp ala asp asn ser leu thr asp ser val ser his pro lys thr leu arg lys thr
121/41                                      151/51
gcg gcg gaa tct aat att cca aag ata tat gga act cga tgc gaa gga atc agg ctc atg
ala ala glu ser asn ile pro lys ile tyr gly thr arg cys glu gly ile arg leu met
181/61                                      211/71
agc aag acg gtt ctc atc ctt ggc gcg ggt gtc ggc ggc ctg acc acc gcc gac acc ctc
ser lys thr val leu ile leu gly ala gly val gly gly leu thr thr ala asp thr leu
241/81                                      271/91
cgt caa ctg cta cca cct gag gat cga atc ata ttg gtg gac agg agc ttt gac ggg acg
arg gln leu leu pro pro glu asp arg ile ile leu val asp arg ser phe asp gly thr
301/101                                     331/111
ctg ggc ttg tcg ttg cta tgg gtg ttg cgg ggc tgg cgg cgg cct gac gac gtc cgc gtc
leu gly leu ser leu leu trp val leu arg gly trp arg arg pro asp asp val arg val
361/121                                     391/131
cgc ccc acc gcg gcg tcg ctg ccc ggt gtg gaa atg gtt act gca acc gtc gcc cac att
arg pro thr ala ala ser leu pro gly val glu met val thr ala thr val ala his ile
421/141                                     451/151
gac atc gcg gcc cag gta gtg cac acc gac aac agc gtc atc ggc tat gac gcg ttg gtg
asp ile ala ala gln val val his thr asp asn ser val ile gly tyr asp ala leu val
481/161                                     511/171
atc gca tta ggt gcg gcg ctg aac acc gac gcc gtt ccc gga ctg tcg gac gcg ctc gac
ile ala leu gly ala ala leu asn thr asp ala val pro gly leu ser asp ala leu asp
541/181                                     571/191
gcc gac gtc gcg ggc cag ttc tac acc ctg gac ggc gcg gct gag ctg cgt gcg aag gtc
ala asp val ala gly gln phe tyr thr leu asp gly ala ala glu leu arg ala lys val
601/201                                     631/211
gag gcg ctc gag cat ggc cgg atc gct gtg gct atc gcc ggg gtg ccg ttc aaa tgc cca
glu ala leu glu his gly arg ile ala val ala ile ala gly val pro phe lys cys pro
661/221                                     691/231
gcc gca ccg ttc gaa gcg gcg ttt ctg atc gcc gcc caa ctc ggt gac cgc tac gcc acc
ala ala pro phe glu ala ala phe leu ile ala ala gln leu gly asp arg tyr ala thr
721/241                                     751/251
gga acc gta cag atc gac acg ttc acg cct gac ccg ctg ccg atg ccc gtt gca ggt ccc
gly thr val gln ile asp thr phe thr pro asp pro leu pro met pro val ala gly pro
781/261                                     811/271
gag gtc ggc gag gct ttg gtc tcg atg ctc aag gat cac ggt gtc ggc ttc cat cct cgc
glu val gly glu ala leu val ser met leu lys asp his gly val gly phe his pro arg
841/281                                     871/291
aag gcc cta gct cgc gtc gat gag gcc gca agg acg atg cac ttc ggt gac ggc acg tcc
lys ala leu ala arg val asp glu ala ala arg thr met his phe gly asp gly thr ser
```

SEQ ID NOS:846-847

FIG. 48E

```
901/301                                931/311
gaa ccg ttc gat ctg ctt gcc gtg gtc ccc ccg cac gtg ccc tcc gcc gcg gcg cgg tca
glu pro phe asp leu leu ala val val pro pro his val pro ser ala ala ala arg ser
961/321                                991/331
gcg ggt ctc agc gaa tcc ggg tgg ata ccc gtg gac ccg cgc acc ctg tcc act agc gcc
ala gly leu ser glu ser gly trp ile pro val asp pro arg thr leu ser thr ser ala
1021/341                               1051/351
gac aac gtg tgg gcc atc ggc gat gcg acc gtg ctg acg ctg ccg aat ggc aaa ccg ctg
asp asn val trp ala ile gly asp ala thr val leu thr leu pro asn gly lys pro leu
1081/361                               1111/371
ccc aag gct gcc gtg ttc gcc gaa gcc cag gcc gca gtt gtc gcc cac ggc gtc gcc cgc
pro lys ala ala val phe ala glu ala gln ala ala val val ala his gly val ala arg
1141/381                               1171/391
cat ctc ggt tac gac gta gct gag cgc cac ttc acc ggc acg ggc gcc tgc tac gtc gag
his leu gly tyr asp val ala glu arg his phe thr gly thr gly ala cys tyr val glu
1201/401                               1231/411
acc ggt gat cac cag gca gcc aag ggc gac ggc gat ttc ttc gct ccg tcg gcg ccc tcg
thr gly asp his gln ala ala lys gly asp gly asp phe phe ala pro ser ala pro ser
1261/421                               1291/431
gtg acg ctg tac ccg ccg tcg cgg gag ttt cac gag gag aag gtc gca caa gaa ctg gcc
val thr leu tyr pro pro ser arg glu phe his glu glu lys val ala gln glu leu ala
1321/441
tgg ctg acc cgc tgg aag acg tga
trp leu thr arg trp lys thr)OPA
```

SEQ ID NOS:846-847 (continued)

FIG. 48E (continued)

Fragment amplified by PCR based on the sequence similarities with a
serine protease of the E.coli htrA family (creation of the BamHI site at
the 5' end and of the SnaBI site at the 3' end) and subcloned into the
vector pJVED:

```
1/1   SEQ ID NO: 848                      31/11
cca tct aca ccg ctc aac agc cgg gcc aga cgc tgc cgg tcg gtg ctg ccg aga agg cgg
(pro ser thr pro leu asn ser arg ala arg arg cys arg ser val leu pro arg arg arg)
61/21  SEQ ID NO: 849                     91/31
tga tcc gtg gcg agt tgt tca tgt cgc ggc gca cca ccg ccg acc aac ggg tgc ttg cca
OPA(ser val ala ser cys ser cys arg gly ala pro pro pro thr asn gly cys leu pro
121/41  SEQ ID NO: 850  SEQ ID NO: 852   151/51
tcc gtc tga cca acg gta gtt cgc tgc tga tct cca aaa gtc tca agc cca ccg aag cag
ser val)OPA(pro thr val val arg cys)OPA(ser pro lys val ser ser pro pro lys gln
181/61         SEQ ID NO: 851             211/71
tca tga aca agc tgc gtt ggg tgc tat ggc tgg gtg gga tcg ggg tgg cgg tcg ccg
ser)OPA(thr ser cys val gly cys tyr)OPA(ser trp val gly ser gly trp arg ser pro
241/81   SEQ ID NO: 853                   271/91  SEQ ID NO: 854
cgg tgg ccg ggg gga tgg tca ccc ggg ccg ggc tga ggc cgg tgg gcc gcc tca ccg aag
arg trp pro gly gly trp ser pro gly pro gly)OPA(gly arg trp ala ala ser pro lys
301/101                                   331/111  SEQ ID NO: 855
cgg ccg agc ggg tgg cgc gaa ccg acg acc tgc ggc cca tcc ccg tct tcg gca gcg acg
arg pro ser gly trp arg glu pro thr thr cys gly pro ser pro ser ser ala ala thr
361/121                                   391/131
aat tgg cca ggc tga cag agg cat tca att taa tgc tgc ggg cgc tgg ccg agt cac ggg
asn trp pro gly)OPA(gln arg his ser ile)OCH(cys cys gly arg trp pro ser his gly
421/141          SEQ ID NO: 856   451/151  SEQ ID NO: 857
aac ggc agg caa ggc tgg tta ccg acg ccg gac atg aat tgc gta ccc cgc taa cgt cgc
asn gly arg gln gly trp leu pro thr pro asp met asn cys val pro arg)OCH(arg arg
481/161                                   511/171     SEQ ID NO: 858
tgc gca cca atg tcg aac tct tga tgg cct cga tgg ccc cgg ggg ctc cgc ggc tac cca
cys ala pro met ser asn ser)OPA(trp pro arg trp pro arg gly leu arg gly tyr pro
541/181        SEQ ID NO: 859             571/191
agc agg aga tgg tcg acc tgc gtg ccg atg tgc tgg ctc aaa tcg agg aat tgt cca cac
ser arg arg trp ser thr cys val pro met cys trp leu lys ser arg asn cys pro his
601/201                                   631/211
tgg tag gcg att tgg tgg acc tgt ccc gag gcg acg ccg gag aag tgg tgc acg agc cgg
trp)AMB(ala ile trp trp thr cys pro glu ala thr pro glu lys trp cys thr ser arg
661/221   SEQ ID NO: 860                  691/231
tcg aca tgg ctg acg tcg tcg acc gca gcc tgg agc ggg tca ggc ggc ggc gca acg ata
ser thr trp leu thr ser ser thr ala ala trp ser gly ser gly gly gly ala thr ile
721/241                                   751/251
tcc ttt tcg acg tcg agg tga ttg ggt ggc agg ttt atg gcg ata ccg ctg gat tgt cgc
ser phe ser thr ser arg)OPA(leu gly gly arg phe met ala ile pro leu asp cys arg
781/261    SEQ ID NO: 861                 811/271
gga tgg cgc tta acc tga tgg aca acg ccg cga agt gga gcc cgc cgg gcg gcc acg tgg
gly trp arg leu thr)OPA(trp thr thr pro arg ser gly ala arg arg ala ala thr trp
841/281  SEQ ID NO: 862                   871/291
gtg tca ggc tga gcc agc tcg acg cgt cgc acg ctg agc tgg tgg ttt ccg acc gcg gcc
val ser gly)OPA(ala ser ser thr arg arg thr leu ser trp trp phe pro thr ala ala
             SEQ ID NO: 863
```

SEQ ID NOS:848-863

FIG. 49A

```
901/301                                     931/311
cgg gca ttc ccg tgc agg agc gcc gtc tgg    tgt ttg aac ggt ttt acc ggt cgg cat cgg
arg ala phe pro cys arg ser ala val trp    cys leu asn gly phe thr gly arg his arg
961/321                                     991/331
cac ggg cgt tgc cgg gtt cgg gcc tcg ggt    tgg cga tcg tca aac agg tgg tgc tca acc
his gly arg cys arg val arg ala ser gly    trp arg ser ser asn arg trp cys ser thr
1021/341                                    1051/351
acg gcg gat tgc tgc gca tcg aag aca ccg    acc cag gcg gcc agc ccc ctg gaa cgt cga
thr ala asp cys cys ala ser lys thr pro    thr gln ala ala ser pro leu glu arg arg
1081/361                                    1111/371
ttt acg tgc tgc tcc ccg gcc gtc gga tgc    cga ttc cgc agc ttc ccg gtg cga cgg ctg
phe thr cys cys ser pro ala val gly cys    arg phe arg ser phe pro val arg arg leu
1141/381                                    1171/391
gcg ctc gga gca cgg aca tcg aga act ctc    ggg gtt cgg cga acg tta tct cag tgg aat
ala leu gly ala arg thr ser arg thr leu    gly val arg arg thr leu ser gln trp asn
1201/401                                    1231/411
ctc agt cca cgc gcg caa cct agt tgt gca    gtt act gtt gaa agc cac acc cat gcc agt
leu ser pro arg ala gln pro ser cys ala    val thr val glu ser his thr his ala ser
1261/421                                    1291/431
cca cgc atg gcc aag ttg gcc cga gta gtg    ggc cta gta cag gaa gag caa cct agc gac
pro arg met ala lys leu ala arg val val    gly leu val gln glu glu gln pro ser asp
1321/441                                    1351/451
atg acg aat cac cca cgg tat tcg cca ccg    ccg cag cag ccg gga acc cca ggt tat gct
met thr asn his pro arg tyr ser pro pro    pro gln gln pro gly thr pro gly tyr ala
1381/461                                    1411/471
cag ggg cag cag caa acg tac agc cag cag    ttc gac tgg cgt tac cca ccg tcc ccg ccc
gln gly gln gln gln thr tyr ser gln gln    phe asp trp arg tyr pro pro ser pro pro
1441/481                                    1471/491
ccg cag cca acc cag tac cgt caa ccc tac    gag gcg ttg ggt ggt acc cgg ccg ggt ctg
pro gln pro thr gln tyr arg gln pro tyr    glu ala leu gly gly thr arg pro gly leu
1501/501                                    1531/511
ata cct ggc gtg att ccg acc atg acg ccc    cct cct ggg atg gtt cgc caa cgc cct cgt
ile pro gly val ile pro thr met thr pro    pro pro gly met val arg gln arg pro arg
1561/521                                    1591/531
gca ggc atg ttg gcc atc ggc gcg gtg acg    ata gcg gtg gtg tcc gcc ggc atc ggc ggc
ala gly met leu ala ile gly ala val thr    ile ala val val ser ala gly ile gly gly
1621/541                                    1651/551
gcg gcc gca tcc ctg gtc ggg ttc aac cgg    gca ccc gcc ggc ccc agc ggc ggc cca gtg
ala ala ala ser leu val gly phe asn arg    ala pro ala gly pro ser gly gly pro val
1681/561                                    1711/571
gct gcc agc gcg gcg cca agc atc ccc gca    gca aac atg ccg ccg ggg tcg gtc gaa cag
ala ala ser ala ala pro ser ile pro ala    ala asn met pro pro gly ser val glu gln
1741/581                                    1771/591
gtg gcg gcc aag gtg gtg ccc agt gtc gtc    atg ttg gaa acc gat ctg ggc cgc cag tcg
val ala ala lys val val pro ser val val    met leu glu thr asp leu gly arg gln ser
1801/601                                    1831/611
gag gag ggc tcc ggc atc att ctg tct gcc    gag ggg ctg atc ttg acc aac aac cac gtg
glu glu gly ser gly ile ile leu ser ala    glu gly leu ile leu thr asn asn his val
1861/621                                    1891/631
atc gcg gcg gcc gcc aag cct ccc ctg ggc    agt ccg ccg ccg aaa acg acg gta
ile ala ala ala ala lys pro pro leu gly    ser pro pro pro lys thr thr val)
```

SEQ ID NOS:848-863 (continued 1)

FIG. 49A (continued 1)

```
1/1    SEQ ID NO: 864                    31/11
cat cta cac cgc tca aca gcc ggg cca gac gct gcc ggt cgg tgc tgc cga gaa ggc ggt
(his leu his arg ser thr ala gly pro asp ala ala gly arg cys cys arg glu gly gly
61/21  SEQ ID NO: 865                    91/31
gat ccg tgg cga gtt gtt cat gtc gcg gcg cac cac cgc cga cca acg ggt gct tgc cat
asp pro trp arg val val his val ala ala his his arg arg pro thr gly ala cys his
121/41                                   151/51
ccg tct gac caa cgg tag ttc gct gct gat ctc caa aag tct caa gcc cac cga agc agt
pro ser asp gln arg)AMB(phe ala ala asp leu gln lys ser gln ala his arg ser ser
181/61 SEQ ID NO: 866                    211/71
cat gaa caa gct gcg ttg ggt gct att gat cgt ggg tgg gat cgg ggt ggc ggt cgc cgc
his glu gln ala ala leu gly ala ile asp arg gly trp asp arg gly gly gly arg arg
241/81                                   271/91
ggt ggc cgg ggg gat ggt cac ccg ggc cgg gct gag gcc ggt ggg ccg cct cac cga agc
gly gly arg gly asp gly his pro gly arg ala glu ala gly gly pro pro his arg ser
301/101                                  331/111
ggc cga gcg ggt ggc gcg aac cga cga cct gcg gcc cat ccc cgt ctt cgg cag cga cga
gly arg ala gly gly ala asn arg arg pro ala ala his pro arg leu arg gln arg arg
361/121                                  391/131
att ggc cag gct gac aga ggc att caa ttt aat gct gcg ggc gct ggc cga gtc acg gga
ile gly gln ala asp arg gly ile gln phe asn ala ala gly ala gly arg val thr gly
421/141                                  451/151
acg gca ggc aag gct ggt tac cga cgc cgg aca tga att gcg tac ccc gct aac gtc gct
thr ala gly lys ala gly tyr arg arg arg thr)OPA(ile ala tyr pro ala asn val ala
481/161                                  511/171    SEQ ID NO: 867
gcg cac caa tgt cga act ctt gat ggc ctc gat ggc ccc ggg ggc tcc gcg gct acc caa
ala his gln cys arg thr leu asp gly leu asp gly pro gly gly ser ala ala thr gln
541/181                                  571/191
gca gga gat ggt cga cct gcg tgc cga tgt gct ggc tca aat cga gga att gtc cac act
ala gly asp gly arg pro ala cys arg cys ala gly ser asn arg gly ile val his thr
601/201                                  631/211
ggt agg cga ttt ggt gga cct gtc ccg agg cga cgc cgg aga agt ggt gca cga gcc ggt
gly arg phe gly gly pro val pro arg arg arg arg ser gly ala arg ala gly
661/221                                  691/231
cga cat ggc tga cgt cgt cga ccg cag cct gga gcg ggt cag gcg gcg gcg caa cga tat
arg his gly)OPA(arg arg arg pro gln pro gly ala gly gln ala ala ala gln arg tyr
721/241       SEQ ID NO: 868             751/251
cct ttt cga cgt cga ggt gat tgg gtg gca ggt tta tgg cga tac cgc tgg att gtc gcg
pro phe arg arg arg gly asp trp val ala gly leu trp arg tyr arg trp ile val ala
781/261                                  811/271
gat ggc gct taa cct gat gga caa cgc cgc gaa gtg gag ccc gcc ggg cgg cca cgt ggg
asp gly ala)OCH(pro asp gly gln arg arg glu val glu pro ala gly arg pro arg gly
841/281       SEQ ID NO: 869             871/291
tgt cag gct gag cca gct cga cgc gtc gca cgc tga gct ggt ggt ttc cga ccg cgg ccc
cys gln ala glu pro ala arg arg val ala arg)OPA(ala gly gly phe arg pro arg pro
901/301                                  931/311    SEQ ID NO: 870
ggg cat tcc cgt gca gga gcg ccg tct ggt gtt tga acg gtt tta ccg gtc ggc atc ggc
gly his ser arg ala gly ala pro ser gly val)OPA(thr val leu pro val gly ile gly
961/321                                  991/331    SEQ ID NO: 871
acg ggc gtt gcc ggg ttc ggg cct cgg gtt ggc gat cgt caa aca ggt ggt gct caa cca
thr gly val ala gly phe gly pro arg val gly asp arg gln thr gly gly ala gln pro
1021/341                                 1051/351
cgg cgg att gct gcg cat cga aga cac cga ccc agg cgg cca gcc ccc tgg aac gtc gat
arg arg ile ala ala his arg arg his arg pro arg arg pro ala pro trp asn val asp
```

SEQ ID NOS:864-877

FIG. 49B

```
1081/361                                              1111/371
tta cgt gct gct ccc cgg ccg tcg gat gcc   gat tcc gca gct tcc cgg tgc gac ggc tgg
leu arg ala ala pro arg pro ser asp ala   asp ser ala ala ser arg cys asp gly trp
1141/381                                              1171/391
cgc tcg gag cac gga cat cga gaa ctc tcg   ggg ttc ggc gaa cgt tat ctc agt gga atc
arg ser glu his gly his arg glu leu ser   gly phe gly glu arg tyr leu ser gly ile
1201/401                                              1231/411
tca gtc cac gcg cgc aac cta gtt gtg cag   tta ctg ttg aaa gcc aca ccc atg cca gtc
ser val his ala arg asn leu val val gln   leu leu leu lys ala thr pro met pro val
1261/421                                              1291/431
cac gca tgg cca agt tgg ccc gag tag tgg   gcc tag tac agg aag agc aac cta gcg aca
his ala trp pro ser trp pro glu)AMB trp   ala AMB(tyr arg lys ser asn leu ala thr)
1321/441                                              1351/451       SEQ ID NO: 872
tga cga atc acc cac ggt att cgc cac cgc   cgc agc agc cgg gaa ccc cag gtt atg ctc
OPA(arg ile thr his gly ile arg his arg   arg ser ser arg glu pro gln val met leu
1381/461       SEQ ID NO: 873                         1411/471
agg ggc agc agc aaa cgt aca gcc agc agt   tcg act ggc gtt acc cac cgt ccc cgc ccc
arg gly ser ser lys arg thr ala ser ser   ser thr gly val thr his arg pro arg pro
1441/481                                              1471/491
cgc agc caa ccc agt acc gtc aac cct acg   agg cgt tgg gtg gta ccc ggc cgg gtc tga
arg ser gln pro ser thr val asn pro thr   arg arg trp val val pro gly arg val)OPA
1501/501                                              1531/511
tac ctg gcg tga ttc cga cca tga cgc ccc   ctc ctg gga tgg ttc gcc aac gcc ctc gtg
tyr leu ala OPA phe arg pro OPA(arg pro   leu leu gly trp phe ala asn ala leu val
1561/521      SEQ ID NO: 874                          1591/531
cag gca tgt tgg cca tcg gcg cgg tga cga   tag cgg tgg tgt ccg ccg gca tcg gcg gcg
gln ala cys trp pro ser ala arg)OPA arg   AMB(arg trp cys pro pro ala ser ala ala
1621/541                                              1651/551       SEQ ID NO: 875
cgg ccg cat ccc tgg tcg ggt tca acc ggg   cac ccg ccg gcc cca gcg gcg gcc cag tgg
arg pro his pro trp ser gly ser thr gly   his pro pro ala pro ala ala ala gln trp
1681/561                                              1711/571
ctg cca gcg cgg cgc caa gca tcc ccg cag   caa aca tgc cgc cgg ggt cgg tcg aac agg
leu pro ala arg arg gln ala ser pro gln   gln thr cys arg arg gly arg ser asn arg
1741/581                                              1771/591
tgg cgg cca agg tgg tgc cca gtg tcg tca   tgt tgg aaa ccg atc tgg gcc gcc agt cgg
trp arg pro arg trp cys pro val ser ser   cys trp lys pro ile trp ala ala ser arg
1801/601                                              1831/611
agg agg gct ccg gca tca ttc tgt ctg ccg   agg ggc tga tct tga cca aca acc acg tga
arg arg ala pro ala ser phe cys leu pro   arg gly)OPA ser OPA(pro thr thr thr)OPA
1861/621                                              1891/631           SEQ ID NO: 876
tcg cgg cgg ccg cca agc ctc ccc tgg gca   gtc cgc cgc cga aaa cga cgg ta
(ser arg arg pro pro ser leu pro trp ala   val arg arg arg lys arg arg)
      SEQ ID NO: 877
```

SEQ ID NOS:864-877 (continued 1)

FIG. 49B (continued 1)

1/1 SEQ ID NO: 878

| | | | | | | | | | | 31/11 | | | | | | | | | |
|---|---|---|---|---|---|---|---|---|---|---|---|---|---|---|---|---|---|---|---|
| atc | tac | acc | gct | caa | cag | ccg | ggc | cag | acg | ctg | ccg | gtc | ggt | gct | gcc | gag | aag | gcg | gtg |
| (ile | tyr | thr | ala | gln | gln | pro | gly | gln | thr | leu | pro | val | gly | ala | ala | glu | lys | ala | val |

61/21 SEQ ID NO: 879                                   91/31 atc cgt ggc gag ttg ttc atg tcg cgg cgc acc acc gcc gac caa cgg gtc ctt gcc atc
ile arg gly glu leu phe met ser arg arg thr thr ala asp gln arg val leu ala ile

121/41                                                 151/51 cgt ctg acc aac ggt agt tcg ctg ctg atc tcc aaa agt ctc aag ccc acc gaa gca gtc
arg leu thr asn gly ser ser leu leu ile ser lys ser leu lys pro thr glu ala val

181/61                                                 211/71 atg aac aag ctg cgt tgg gtg cta ttg atc gtg ggt ggg atc ggg gtg gcg gtc gcc gcg
met asn lys leu arg trp val leu leu ile val gly gly ile gly val ala val ala ala

241/81                                                 271/91 gtg gcc ggg ggg atg gtc acc cgg gcc ggg ctg agg ccg gtg ggc cgc ctc acc gaa gcg
val ala gly gly met val thr arg ala gly leu arg pro val gly arg leu thr glu ala

301/101                                                331/111 gcc gag cgg gtg gcg cga acc gac gac ctg cgg ccc atc ccc gtc ttc ggc agc gac gaa
ala glu arg val ala arg thr asp asp leu arg pro ile pro val phe gly ser asp glu

361/121                                                391/131 ttg gcc agg ctg aca gag gca ttc aat tta atg ctg cgg gcg ctg gcc gag tca cgg gaa
leu ala arg leu thr glu ala phe asn leu met leu arg ala leu ala glu ser arg glu

421/141                                                451/151 cgg cag gca agg ctg gtt acc gac gcc gga cat gaa ttg cgt acc ccg cta acg tcg ctg
arg gln ala arg leu val thr asp ala gly his glu leu arg thr pro leu thr ser leu

481/161                                                511/171 cgc acc aat gtc gaa ctc ttg atg gcc tcg atg gcc ccg ggg gct ccg cgg cta ccc aag
arg thr asn val glu leu leu met ala ser met ala pro gly ala pro arg leu pro lys

541/181                                                571/191 cag gag atg gtc gac ctg cgt gcc gat gtg ctg gct caa atc gag gaa ttg tcc aca ctg
gln glu met val asp leu arg ala asp val leu ala gln ile glu glu leu ser thr leu

601/201                                                631/211 gta ggc gat ttg gtg gac ctg tcc cga ggc gac gcc gga gaa gtg gtg cac gag ccg gtc
val gly asp leu val asp leu ser arg gly asp ala gly glu val val his glu pro val

661/221                                                691/231 gac atg gct gac gtc gtc gac cgc agc ctg gag cgg gtc agg cgg cgg cgc aac gat atc
asp met ala asp val val asp arg ser leu glu arg val arg arg arg arg asn asp ile

721/241                                                751/251 ctt ttc gac gtc gag gtg att ggg tgg cag gtt tat ggc gat acc gct gga ttg tcg cgg
leu phe asp val glu val ile gly trp gln val tyr gly asp thr ala gly leu ser arg

781/261                                                811/271 atg gcg ctt aac ctg atg gac aac gcc gcg aag tgg agc ccg ccg ggc ggc cac gtg ggt
met ala leu asn leu met asp asn ala ala lys trp ser pro pro gly gly his val gly

841/281                                                871/291 gtc agg ctg agc cag ctc gac gcg tcg cac gct gag ctg gtg gtt tcc gac cgc ggc ccg
val arg leu ser gln leu asp ala ser his ala glu leu val val ser asp arg gly pro

901/301                                                931/311 ggc att ccc gtg cag gag cgc cgt ctg gtg ttt gaa cgg ttt tac cgg tcg gca tcg gca
gly ile pro val gln glu arg arg leu val phe glu arg phe tyr arg ser ala ser ala

961/321                                                991/331 cgg gcg ttg ccg ggt tcg ggc ctc ggg ttg gcg atc gtc aaa cag gtg gtg ctc aac cac
arg ala leu pro gly ser gly leu gly leu ala ile val lys gln val val leu asn his

SEQ ID NOS:878-882

FIG. 49C

```
1021/341                                1051/351
ggc gga ttg ctg cgc atc gaa gac acc gac cca ggc ggc cag ccc cct gga acg tcg att
gly gly leu leu arg ile glu asp thr asp pro gly gly gln pro pro gly thr ser ile
1081/361                                1111/371
tac gtg ctg ctc ccc ggc cgt cgg atg ccg att ccg cag ctt ccc ggt gcg acg gct ggc
tyr val leu leu pro gly arg arg met pro ile pro gln leu pro gly ala thr ala gly
1141/381                                1171/391
gct cgg agc acg gac atc gag aac tct cgg ggt tcg gcg aac gtt atc tca gtg gaa tct
ala arg ser thr asp ile glu asn ser arg gly ser ala asn val ile ser val glu ser
1201/401                                1231/411
cag tcc acg cgc gca acc tag ttg tgc agt tac tgt tga aag cca cac cca tgc cag tcc
gln ser thr arg ala thr)AMB(leu cys ser tyr cys)OPA(lys pro his pro cys gln ser
1261/421      SEQ ID NO: 880            1291/431        SEQ ID NO: 881
acg cat ggc caa gtt ggc ccg agt agt ggg cct agt aca gga aga gca acc tag cga cat
thr his gly gln val gly pro ser ser gly pro ser thr gly arg ala thr)AMB(arg his
1321/441                                1351/451        SEQ ID NO: 882
gac gaa tca ccc acg gta ttc gcc acc gcc gca gca gcc ggg aac ccc agg tta tgc tca
asp glu ser pro thr val phe ala thr ala ala ala ala gly asn pro arg leu cys ser
1381/461                                1411/471
ggg gca gca gca aac gta cag cca gca gtt cga ctg gcg tta ccc acc gtc ccc gcc ccc
gly ala ala ala asn val gln pro ala val arg leu ala leu pro thr val pro ala pro
1441/481                                1471/491
gca gcc aac cca gta ccg tca acc cta cga ggc gtt ggg tgg tac ccg gcc ggg tct gat
ala ala asn pro val pro ser thr leu arg gly val gly trp tyr pro ala gly ser asp
1501/501                                1531/511
acc tgg cgt gat tcc gac cat gac gcc ccc tcc tgg gat ggt tcg cca acg ccc tcg tgc
thr trp arg asp ser asp his asp ala pro ser trp asp gly ser pro thr pro ser cys
1561/521                                1591/531
agg cat gtt ggc cat cgg cgc ggt gac gat agc ggt ggt gtc cgc cgg cat cgg cgg cgc
arg his val gly his arg arg gly asp asp ser gly gly val arg arg his arg arg arg
1621/541                                1651/551
ggc cgc atc cct ggt cgg gtt caa ccg ggc acc cgc cgg ccc cag cgg cgg ccc agt ggc
gly arg ile pro gly arg val gln pro gly thr arg arg pro gln arg arg pro ser gly
1681/561                                1711/571
tgc cag cgc ggc gcc aag cat ccc cgc agc aaa cat gcc gcc ggg gtc ggt cga aca ggt
cys gln arg gly ala lys his pro arg ser lys his ala ala gly val gly arg thr gly
1741/581                                1771/591
ggc ggc caa ggt ggt gcc cag tgt cgt cat gtt gga aac cga tct ggg ccg cca gtc gga
gly gly gln gly gly ala gln cys arg his val gly asn arg ser gly pro pro val gly
1801/601                                1831/611
gga ggg ctc cgg cat cat tct gtc tgc cga ggg gct gat ctt gac caa caa cca cgt gat
gly gly leu arg his his ser val cys arg gly ala asp leu asp gln gln pro arg asp
1861/621                                1891/631
cgc ggc ggc cgc caa gcc tcc cct ggg cag tcc gcc gcc gaa aac gac ggt a
arg gly gly arg gln ala ser pro gly gln ser ala ala glu asn asp gly)
```

SEQ ID NOS:878-882 (continued 1)

FIG. 49C (continued 1)

Coding sequence Rv0983 predicted by Cole et al., 1998 (Nature 393:537-544)
and containing seq60A:

```
1/1   SEQ ID NO: 883                      31/11
atg gcc aag ttg gcc cga gta gtg ggc cta gta cag gaa gag caa cct agc gac atg acg
(Met ala lys leu ala arg val val gly leu val gln glu glu gln pro ser asp met thr
61/21   SEQ ID NO: 884                    91/31
aat cac cca cgg tat tcg cca ccg ccg cag cag ccg gga acc cca ggt tat gct cag ggg
asn his pro arg tyr ser pro pro pro gln gln pro gly thr pro gly tyr ala gln gly
121/41                                    151/51
cag cag caa acg tac agc cag cag ttc gac tgg cgt tac cca ccg tcc ccg ccc ccg cag
gln gln gln thr tyr ser gln gln phe asp trp arg tyr pro pro ser pro pro pro gln
181/61                                    211/71
cca acc cag tac cgt caa ccc tac gag gcg ttg ggt ggt acc cgg ccg ggt ctg ata cct
pro thr gln tyr arg gln pro tyr glu ala leu gly gly thr arg pro gly leu ile pro
241/81                                    271/91
ggc gtg att ccg acc atg acg ccc cct cct ggg atg gtt cgc caa cgc cct cgt gca ggc
gly val ile pro thr met thr pro pro pro gly met val arg gln arg pro arg ala gly
301/101                                   331/111
atg ttg gcc atc ggc gcg gtg acg ata gcg gtg gtg tcc gcc ggc atc ggc ggc gcg gcc
met leu ala ile gly ala val thr ile ala val val ser ala gly ile gly gly ala ala
361/121                                   391/131
gca tcc ctg gtc ggg ttc aac cgg gca ccc gcc ggc ccc agc ggc ggc cca gtg gct gcc
ala ser leu val gly phe asn arg ala pro ala gly pro ser gly gly pro val ala ala
421/141                                   451/151
agc gcg gcg cca agc atc ccc gca gca aac atg ccg ccg ggg tcg gtc gaa cag gtg gcg
ser ala ala pro ser ile pro ala ala asn met pro pro gly ser val glu gln val ala
481/161                                   511/171
gcc aag gtg gtg ccc agt gtc gtc atg ttg gaa acc gat ctg ggc cgc cag tcg gag gag
ala lys val val pro ser val val met leu glu thr asp leu gly arg gln ser glu glu
541/181                                   571/191
ggc tcc ggc atc att ctg tct gcc gag ggg ctg atc ttg acc aac aac cac gtg atc gcg
gly ser gly ile ile leu ser ala glu gly leu ile leu thr asn asn his val ile ala
601/201                                   631/211
gcg gcc gcc aag cct ccc ctg ggc agt ccg ccg ccg aaa acg acg gta acc ttc tct gac
ala ala ala lys pro pro leu gly ser pro pro pro lys thr thr val thr phe ser asp
661/221                                   691/231
ggg cgg acc gca ccc ttc acg gtg gtg ggg gct gac ccc acc agt gat atc gcc gtc gtc
gly arg thr ala pro phe thr val val gly ala asp pro thr ser asp ile ala val val
721/241                                   751/251
cgt gtt cag ggc gtc tcc ggg ctc acc ccg atc tcc ctg ggt tcc tcg gac ctg agg
arg val gln gly val ser gly leu thr pro ile ser leu gly ser ser ser asp leu arg
781/261                                   811/271
gtc ggt cag ccg gtg ctg gcg atc ggg tcg ccg ctc ggt ttg gag ggc acc gtg acc acg
val gly gln pro val leu ala ile gly ser pro leu gly leu glu gly thr val thr thr
```

SEQ ID NOS:883-884

FIG. 49D

```
841/281                              871/291
ggg atc gtc agc gct ctc aac cgt cca gtg tcg acg acc ggc gag gcc ggc aac cag aac
gly ile val ser ala leu asn arg pro val ser thr thr gly glu ala gly asn gln asn
901/301                              931/311
acc gtg ctg gac gcc att cag acc gac gcc gcg atc aac ccc ggt aac tcc ggg ggc gcg
thr val leu asp ala ile gln thr asp ala ala ile asn pro gly asn ser gly gly ala
961/321                              991/331
ctg gtg aac atg aac gct caa ctc gtc gga gtc aac tcg gcc att gcc acg ctg ggc gcg
leu val asn met asn ala gln leu val gly val asn ser ala ile ala thr leu gly ala
1021/341                             1051/351
gac tca gcc gat gcg cag agc ggc tcg atc ggt ctc ggt ttt gcg att cca gtc gac cag
asp ser ala asp ala gln ser gly ser ile gly leu gly phe ala ile pro val asp gln
1081/361                             1111/371
gcc aag cgc atc gcc gac gag ttg atc agc acc ggc aag gcg tca cat gcc tcc ctg ggt
ala lys arg ile ala asp glu leu ile ser thr gly lys ala ser his ala ser leu gly
1141/381                             1171/391
gtg cag gtg acc aat gac aaa gac acc ctg ggc gcc aag atc gtc gaa gta gtg gcc ggt
val gln val thr asn asp lys asp thr leu gly ala lys ile val glu val val ala gly
1201/401                             1231/411
ggt gct gcc gcg aac gct gga gtg ccg aag ggc gtc gtt gtc acc aag gtc gac gac cgc
gly ala ala ala asn ala gly val pro lys gly val val val thr lys val asp asp arg
1261/421                             1291/431
ccg atc aac agc gcg gac gcg ttg gtt gcc gcc gtg cgg tcc aaa gcg ccg ggc gcc acg
pro ile asn ser ala asp ala leu val ala ala val arg ser lys ala pro gly ala thr
1321/441                             1351/451
gtg gcg cta acc ttt cag gat ccc tcg ggc ggt agc cgc aca gtg caa gtc acc ctc ggc
val ala leu thr phe gln asp pro ser gly gly ser arg thr val gln val thr leu gly
1381/461
aag gcg gag cag tga
lys ala glu gln)OPA
```

SEQ ID NOS:883-884 (continued 1)

FIG. 49D (continued 1)

ORF according to Cole et al., 1998 (Nature 393:537-544) and containing Rv0983

1/1 SEQ ID NO: 885                                        31/11
tga gcc agc tcg acg cgt cgc acg ctg agc    tgg tgg ttt ccg acc gcg gcc cgg gca ttc
OPA(ala ser ser thr arg arg thr leu ser    trp trp phe pro thr ala ala arg ala phe
61/21 SEQ ID NO: 886                                      91/31
ccg tgc agg agc gcc gtc tgg tgt ttg aac    ggt ttt acc ggt cgg cat cgg cac ggg cgt
pro cys arg ser ala val trp cys leu asn    gly phe thr gly arg his arg his gly arg
121/41                                                    151/51
tgc cgg gtt cgg gcc tcg ggt tgg cga tcg    tca aac agg tgg tgc tca acc acg gcg gat
cys arg val arg ala ser gly trp arg ser    ser asn arg trp cys ser thr thr ala asp
181/61                                                    211/71
tgc tgc gca tcg aag aca ccg acc cag gcg    gcc agc ccc ctg gaa cgt cga ttt acg tgc
cys cys ala ser lys thr pro thr gln ala    ala ser pro leu glu arg arg phe thr cys
241/81                                                    271/91
tgc tcc ccg gcc gtc gga tgc cga ttc cgc    agc ttc ccg gtg cga cgg ctg gcg ctc gga
cys ser pro ala val gly cys arg phe arg    ser phe pro val arg arg leu ala leu gly
301/101                                                   331/111
gca cgg aca tcg aga act ctc ggg gtt cgg    cga acg tta tct cag tgg aat ctc agt cca
ala arg thr ser arg thr leu gly val arg    arg thr leu ser gln trp asn leu ser pro
361/121                                                   391/131
cgc gcg caa cct agt tgt gca gtt act gtt    gaa agc cac acc cat gcc agt cca cgc atg
arg ala gln pro ser cys ala val thr val    glu ser his thr his ala ser pro arg met
421/141                                                   451/151
gcc aag ttg gcc cga gta gtg ggc cta gta    cag gaa gag caa cct agc gac atg acg aat
ala lys leu ala arg val val gly leu val    gln glu glu gln pro ser asp met thr asn
481/161                                                   511/171
cac cca cgg tat tcg cca ccg ccg cag cag    ccg gga acc cca ggt tat gct cag ggg cag
his pro arg tyr ser pro pro pro gln gln    pro gly thr pro gly tyr ala gln gly gln
541/181                                                   571/191
cag caa acg tac agc cag cag ttc gac tgg    cgt tac cca ccg tcc ccg ccc ccg cag cca
gln gln thr tyr ser gln gln phe asp trp    arg tyr pro pro ser pro pro pro gln pro
601/201                                                   631/211
acc cag tac cgt caa ccc tac gag gcg ttg    ggt ggt acc cgg ccg ggt ctg ata cct ggc
thr gln tyr arg gln pro tyr glu ala leu    gly gly thr arg pro gly leu ile pro gly
661/221                                                   691/231
gtg att ccg acc atg acg ccc cct cct ggg    atg gtt cgc caa cgc cct cgt gca ggc atg
val ile pro thr met thr pro pro pro gly    met val arg gln arg pro arg ala gly met
721/241                                                   751/251
ttg gcc atc ggc gcg gtg acg ata gcg gtg    gtg tcc gcc ggc atc ggc ggc gcg gcc gca
leu ala ile gly ala val thr ile ala val    val ser ala gly ile gly gly ala ala ala
781/261                                                   811/271
tcc ctg gtc ggg ttc aac cgg gca ccc gcc    ggc ccc agc ggc ggc cca gtg gct gcc agc
ser leu val gly phe asn arg ala pro ala    gly pro ser gly gly pro val ala ala ser
841/281                                                   871/291
gcg gcg cca agc atc ccc gca gca aac atg    ccg ccg ggg tcg gtc gaa cag gtg gcg gcc
ala ala pro ser ile pro ala ala asn met    pro pro gly ser val glu gln val ala ala

SEQ ID NOS:885-886

FIG. 49E

```
901/301                              931/311
aag gtg gtg ccc agt gtc gtc atg ttg gaa acc gat ctg ggc cgc cag tcg gag gag ggc
lys val val pro ser val val met leu glu thr asp leu gly arg gln ser glu glu gly
961/321                              991/331
tcc ggc atc att ctg tct gcc gag ggg ctg atc ttg acc aac aac cac gtg atc gcg gcg
ser gly ile ile leu ser ala glu gly leu ile leu thr asn asn his val ile ala ala
1021/341                             1051/351
gcc gcc aag cct ccc ctg ggc agt ccg ccg ccg aaa acg acg gta acc ttc tct gac ggg
ala ala lys pro pro leu gly ser pro pro lys thr thr val thr phe ser asp gly
1081/361                             1111/371
cgg acc gca ccc ttc acg gtg gtg ggg gct gac ccc acc agt gat atc gcc gtc gtc cgt
arg thr ala pro phe thr val val gly ala asp pro thr ser asp ile ala val val arg
1141/381                             1171/391
gtt cag ggc gtc tcc ggg ctc acc ccg atc tcc ctg ggt tcc tcc tcg gac ctg agg gtc
val gln gly val ser gly leu thr pro ile ser leu gly ser ser ser asp leu arg val
1201/401                             1231/411
ggt cag ccg gtg ctg gcg atc ggg tcg ccg ctc ggt ttg gag ggc acc gtg acc acg ggg
gly gln pro val leu ala ile gly ser pro leu gly leu glu gly thr val thr thr gly
1261/421                             1291/431
atc gtc agc gct ctc aac cgt cca gtg tcg acg acc ggc gag gcc ggc aac cag aac acc
ile val ser ala leu asn arg pro val ser thr thr gly glu ala gly asn gln asn thr
1321/441                             1351/451
gtg ctg gac gcc att cag acc gac gcc gcg atc aac ccc ggt aac tcg ggc gcg ctg
val leu asp ala ile gln thr asp ala ala ile asn pro gly asn ser gly gly ala leu
1381/461                             1411/471
gtg aac atg aac gct caa ctc gtc gga gtc aac tcg gcc att gcc acg ctg ggc gcg gac
val asn met asn ala gln leu val gly val asn ser ala ile ala thr leu gly ala asp
1441/481                             1471/491
tca gcc gat gcg cag agc ggc tcg atc ggt ctc ggt ttt gcg att cca gtc gac cag gcc
ser ala asp ala gln ser gly ser ile gly leu gly phe ala ile pro val asp gln ala
1501/501                             1531/511
aag cgc atc gcc gac gag ttg atc agc acc ggc aag gcg tca cat gcc tcc ctg ggt gtg
lys arg ile ala asp glu leu ile ser thr gly lys ala ser his ala ser leu gly val
1561/521                             1591/531
cag gtg acc aat gac aaa gac acc ctg ggc gcc aag atc gtc gaa gta gtg gcc ggt ggt
gln val thr asn asp lys asp thr leu gly ala lys ile val glu val val ala gly gly
1621/541                             1651/551
gct gcc gcg aac gct gga gtg ccg aag ggc gtc gtt gtc acc aag gtc gac gac cgc ccg
ala ala ala asn ala gly val pro lys gly val val val thr lys val asp asp arg pro
1681/561                             1711/571
atc aac agc gcg gac gcg ttg gtt gcc gcc gtg cgg tcc aaa gcg ccg ggc gcc acg gtg
ile asn ser ala asp ala leu val ala ala val arg ser lys ala pro gly ala thr val
1741/581                             1771/591
gcg cta acc ttt cag gat ccc tcg ggc ggt agc cgc aca gtg caa gtc acc ctc ggc aag
ala leu thr phe gln asp pro ser gly gly ser arg thr val gln val thr leu gly lys
1801/601
gcg gag cag tga
ala glu gln)OPA
```

SEQ ID NOS:885-886 (continued 1)

FIG. 49E (continued 1)

Fragment amplified by PCR based on the sequence similarities with a serine
protease of the E.coli HtrA family (creation of an SnaBI site at the
3' end) and subcloned into the vector pJVEDa:

```
1/1    SEQ ID NO: 887                    31/11
gat ccg gcg ggg cgg gtg tcg gcg cag gcg  tgg ctg gcg gtc acg gcg gtg cgg gcg gtg
(asp pro ala gly arg val ser ala gln ala trp leu ala val thr ala val arg ala val
61/21   SEQ ID NO: 888                   91/31
ccg ccg ggc tgt ggg gcg ccg gcg gcg gcg  gtg gca atg gcg gga acg gcg ccg atg cca
pro pro gly cys gly ala pro ala ala ala  val ala met ala gly thr ala pro met pro
121/41                                   151/51
aca tcg tca gcg gtg gag acg gtg gcc tcg  gcg gtg ccg gtg gcg gtg gcg gat ggc tct
thr ser ser ala val glu thr val ala ser  ala val pro val ala val ala asp gly ser
181/61                                   211/71
acg gcg acg gcg ggg ccg gcg gac acg gcg  gac aag gcg caa tcg gcc tcg gcg gcg gcg
thr ala thr ala gly pro ala asp thr ala  asp lys ala gln ser ala ser ala ala ala
241/81                                   271/91
ccg gcg acg ggg gcc agg gcg gcg ccg gcc  gcg gac tgt ggg gta ctg gcg gcg ccg
pro ala thr gly ala arg ala ala pro ala  ala asp cys gly val leu ala ala pro
301/101                                  331/111
gcg gac acg gcg ggc aag gcg gtg gta ccg  ggg gcc cac cgc tgc ccg gtc agg cag gca
ala asp thr ala gly lys ala val val pro  gly ala his arg cys pro val arg gln ala
361/121                                  391/131
tgg gcg ccg cgg gtg gcg ccg gtg ggc tga  tcg gca acg gcg ggg ccg gcg gcg acg gcg
trp ala pro arg val ala pro val gly)OPA(ser ala thr ala gly pro ala ala thr ala
421/141         SEQ ID NO: 889           451/151
gtg tcg gcg cgt ccg gcg ggg tcg ccg gag  tag gcg gtg ccg gcg gga acg cca tgc tga
val ser ala arg pro ala gly ser pro glu)AMB(ala val pro ala gly thr pro cys)OPA
481/161                                  511/171   SEQ ID NO: 890
tcg ggc acg gcg gcg ccg gcg gcg ccg gcg  gag aca gca gtt tcg cta atg gcg cgg ccg
(ser gly thr ala ala pro ala ala pro ala glu thr ala val ser leu met ala arg pro
541/181   SEQ ID NO: 891                 571/191
gcg gcg cgg gcg gtg ccg gag ggc acc tct  tcg gca atg gcg ggt ccg gcg gcc acg gcg
ala ala arg ala val pro glu gly thr ser  ser ala met ala gly pro ala ala thr ala
601/201                                  631/211
gag ccg tca cgg ccg gca aca ccg gta tcg  gtg gcg ccg gcg gcg tcg gtg ggg acg cca
glu pro ser arg pro ala thr pro val ser  val ala pro ala ala ser val gly thr pro
661/221                                  691/231
ggc tga tcg gcc acg gtg gcg ccg gcg gtg  ccg gcg ggg acc gcg ccg gag cct tgg ttg
gly)OPA(ser ala thr val ala pro ala val  pro ala gly thr ala pro glu pro trp leu
721/241   SEQ ID NO: 892                 751/251
gcc gtg acg gcg ggc ccg gtg gga acg ggg  gcg gcc agc tat acg gca acg gcg
ala val thr ala gly pro val gly thr gly  ala leu ala ala ser tyr thr ala thr ala
781/261                                  811/271
gcg acg gcg ccc ccg gca ccg gcg gaa cac  tgc agg cgg cgg tga gcg gat tgg tga cgg
ala thr ala pro pro ala pro ala glu his  cys arg arg arg)OPA ala asp trp OPA(arg
841/281                                  871/291        SEQ ID NO: 893
ctt tgt tcg gtg cac ccg gcc aac ccg gcg  aca ccg gcc aac ccg gct agc ccc gat caa
leu cys ser val his pro ala asn pro ala  thr pro ala asn pro ala ser pro asp gln
901/301                                  931/311
cga ggg ttt cgg tgc cgg tcc ggg gca tgg  cca tcc gct gag ctg gcg atc tgg act acg
arg gly phe arg cys arg ser gly ala trp  pro ser ala glu leu ala ile trp thr thr
961/321                                  991/331
ttg gtg tag aaa aat cct gcc gcc cgg acc  ctt aag gct ggg aca att tct gat agc tac
leu val)AMB(lys asn pro ala ala arg thr  leu lys ala gly thr ile ser asp ser tyr
1021/341    SEQ ID NO: 894               1051/351
ccc gac aca gga ggt tac ggg atg agc aat  tcg cgc cgc cgc tca ctc agg tgg tca tgg
pro asp thr gly gly tyr gly met ser asn  ser arg arg arg ser leu arg trp ser trp
1081/361                                 1111/371
ttg ctg agc gtg ctg gct gcc gtc ggg ctg  ggc ctg gcc acg gcg ccg gcc cag gcg gcc
leu leu ser val leu ala ala val gly leu  gly leu ala thr ala pro ala gln ala ala
1141/381
ccg ccg gcc ttg tcg cag gac cgg tt
pro pro ala leu ser gln asp arg)
```

SEQ ID NOS:887-894

FIG. 50A

```
1/1   SEQ ID NO: 895                        31/11
atc cgg cgg ggc ggg tgt cgg cgc agg cgt   ggc tgg cgg tca cgg cgg tgc ggg cgg tgc
(ile arg arg gly gly cys arg arg arg arg   gly trp arg ser arg arg cys gly arg cys
61/21   SEQ ID NO: 896                     91/31
cgc cgg gct gtg ggg cgc cgg cgg cgg cgg   tgg caa tgg cgg gaa cgg cgc cga tgc caa
arg arg ala val gly arg arg arg arg arg   trp gln trp arg glu arg arg arg cys gln
121/41                                    151/51
cat cgt cag cgg tgg aga cgg tgg cct cgg   tgc cgg tgg cgg tgg cgg atg gct cta
his arg gln arg trp arg arg trp pro arg   arg cys arg trp arg trp arg met ala leu
181/61                                    211/71
cgg cga cgg cgg ggc cgg cgg aca cgg cgg   aca agg cgc aat cgg cct cgg cgg cgc
arg arg arg arg gly arg arg thr arg arg   thr arg asn arg pro arg arg arg arg
241/81                                    271/91
cgg cgg cga cgg ggg cca ggg cgg cgc cgg   ccg cgg act gtg ggg tac tgg cgg cgc cgg
arg arg arg arg gly pro gly arg arg arg   pro arg thr val gly tyr trp arg arg arg
301/101                                   331/111
cgg aca cgg cgg gca agg cgg tgg tac cgg   ggg ccc acc gct gcc cgg tca ggc agg cat
arg thr arg arg ala arg arg trp tyr arg   gly pro thr ala ala arg ser gly arg his
361/121                                   391/131
ggg cgc cgc ggg tgg cgc cgg tgg gct gat   cgg caa cgg cgg ggc cgg cgg cga cgg cgg
gly arg arg gly trp arg arg trp ala asp   arg gln arg arg gly arg arg arg arg arg
421/141                                   451/151
tgt cgg cgc gtc cgg cgg ggt cgc cgg agt   agg cgg tgc cgg cgg gaa cgc cat gct gat
cys arg arg val arg arg gly arg arg ser   arg arg cys arg arg glu arg his ala asp
481/161                                   511/171
cgg gca cgg cgg cgc cgg cgg cgc cgg cgg   aga cag cag ttt cgc taa tgg cgc ggc cgg
arg ala arg arg arg arg arg arg arg arg   arg gln gln phe arg)OCH(trp arg gly arg
541/181                                   571/191   SEQ ID NO: 897
cgg cgc ggg cgg tgc cgg agg gca cct ctt   cgg caa tgg cgg gtc cgg cgg cca cgg cgg
arg arg gly arg cys arg arg ala pro leu   arg gln trp arg val arg arg pro arg arg
601/201                                   631/211
agc cgt cac ggc cgg caa cac cgg tat cgg   tgg cgc cgg cgg cgt cgg tgg gga cgc cag
ser arg his gly arg gln his arg tyr arg   trp arg arg arg arg trp gly arg gln
661/221                                   691/231
gct gat cgg cca cgg tgg cgc cgg cgg tgc   cgg cgg gga ccg cgc cgg agc ctt ggt tgg
ala asp arg pro arg trp arg arg arg cys   arg arg gly pro arg arg ser leu gly trp
721/241                                   751/251
ccg tga cgg cgg gcc cgg tgg gaa cgg ggg   cgc tgg cgg cca gct ata cgg caa cgg cgg
pro)OPA(arg arg ala arg trp glu arg gly   arg trp arg pro ala ile arg gln arg arg
781/261   SEQ ID NO: 898                   811/271
cga cgg cgc ccc cgg cac cgg cgg aac act   gca ggc ggc ggt gag cgg att ggt gac ggc
arg arg arg pro arg his arg arg asn thr   ala gly gly gly glu arg ile gly asp gly
841/281                                   871/291
ttt gtt cgg tgc acc cgg cca acc cgg cga   cac cgg cca acc cgg cta gcc ccg atc aac
phe val arg cys thr arg pro thr arg arg   his arg pro thr arg leu ala pro ile asn
901/301                                   931/311
gag ggt ttc ggt gcc ggt ccg ggg cat ggc   cat ccg ctg agc tgg cga tct gga cta cgt
glu gly phe gly ala gly pro gly his gly   his pro leu ser trp arg ser gly leu arg
961/321                                   991/331
tgg tgt aga aaa atc ctg ccg ccc gga ccc   tta agg ctg gga caa ttt ctg ata gct acc
trp cys arg lys ile leu pro pro gly pro   leu arg leu gly gln phe leu ile ala thr
1021/341                                  1051/351
ccg aca cag gag gtt acg gga tga gca att   cgc gcc gcc gct cac tca ggt ggt cat ggt
pro thr gln glu val thr gly)OPA(ala ile   arg ala ala ala his ser gly gly his gly
1081/361   SEQ ID NO: 899                  1111/371
tgc tga gcg tgc tgg ctg ccg tcg ggc tgg   gcc tgg cca cgg cgg ccc agg cgg ccc
cys)OPA(ala cys trp leu pro ser gly trp   ala trp pro arg arg arg pro arg arg pro
1141/381   SEQ ID NO: 900
cgc cgg cct tgt cgc agg acc ggt t
arg arg pro cys arg arg thr gly)
```

SEQ ID NOS:895-900

FIG.50B

```
1/1    SEQ ID NO: 901                    31/11
tcc ggc ggg gcg ggt gtc ggc gca ggc gtg gct ggc ggt cac ggc ggt gcg ggc ggt gcc
(ser gly gly ala gly val gly ala gly val ala gly gly his gly gly ala gly gly ala
61/21   SEQ ID NO: 902                   91/31
gcc ggg ctg tgg ggc gcc ggc ggc ggt ggc aat ggc ggg aac ggc gcc gat gcc aac
ala gly leu trp gly ala gly gly gly gly gly asn gly gly asn gly ala asp ala asn
121/41                                   151/51
atc gtc agc ggt gga gac ggt ggc ctc ggc ggt gcc ggt ggc ggt ggc gga tgg ctc tac
ile val ser gly gly asp gly gly leu gly gly ala gly gly gly gly gly trp leu tyr
181/61                                   211/71
ggc gac ggc ggg gcc ggc gga cac ggc gga caa ggc gca atc ggc ctc ggc ggc ggc gcc
gly asp gly gly ala gly gly his gly gly gln gly ala ile gly leu gly gly gly ala
241/81                                   271/91
ggc ggc gac ggg ggc cag ggc ggc gcc ggc cgc gga ctg tgg ggt act ggc ggc gcc ggc
gly gly asp gly gly gln gly gly ala gly arg gly leu trp gly thr gly gly ala gly
301/101                                  331/111
gga cac ggc ggg caa ggc ggt ggt acc ggg ggc cca ccg ctg ccc ggt cag gca ggc atg
gly his gly gly gln gly gly gly thr gly gly pro pro leu pro gly gln ala gly met
361/121                                  391/131
ggc gcc gcg ggt ggc gcc ggt ggg ctg atc ggc aac ggc ggg gcc ggc ggc gac ggc ggt
gly ala ala gly gly ala gly gly leu ile gly asn gly gly ala gly gly asp gly gly
421/141                                  451/151
gtc ggc gcg tcc ggc ggg gtc gcc gga gta ggc ggt gcc ggc ggg aac gcc atg ctg atc
val gly ala ser gly gly val ala gly val gly gly ala gly gly asn ala met leu ile
481/161                                  511/171
ggg cac ggc ggc gcc ggc ggc gcc ggc gga gac agc agt ttc gct aat ggc gcg gcc ggc
gly his gly gly ala gly gly ala gly gly asp ser ser phe ala asn gly ala ala gly
541/181                                  571/191
ggc gcg ggc ggt gcc gga ggg cac ctc ttc ggc aat ggc ggg tcc ggc ggc cac ggc gga
gly ala gly gly ala gly gly his leu phe gly asn gly gly ser gly gly his gly gly
601/201                                  631/211
gcc gtc acg gcc ggc aac acc ggt atc ggt ggc ggc gtc ggt ggg gac gcc agg
ala val thr ala gly asn thr gly ile gly gly ala gly gly val gly gly asp ala arg
661/221                                  691/231
ctg atc ggc cac ggt ggc gcc ggc ggt gcc ggc ggg gac cgc gcc gga gcc ttg gtt ggc
leu ile gly his gly gly ala gly gly ala gly gly asp arg ala gly ala leu val gly
721/241                                  751/251
cgt gac ggc ggg ccc ggt ggg aac ggg ggc gct ggc ggc cag cta tac ggc aac ggc ggc
arg asp gly gly pro gly gly asn gly gly ala gly gly gln leu tyr gly asn gly gly
781/261                                  811/271
gac ggc gcc ccc ggc acc ggc gga aca ctg cag gcg gcg gtg agc gga ttg gtg acg gct
asp gly ala pro gly thr gly gly thr leu gln ala ala val ser gly leu val thr ala
841/281                                  871/291
ttg ttc ggt gca ccc ggc caa ccc ggc gac acc ggc caa ccc ggc tag ccc cga tca acg
leu phe gly ala pro gly gln pro gly asp thr gly gln pro gly)AMB(pro arg ser thr
901/301                                  931/311  SEQ ID NO: 903
agg gtt tcg gtg ccg gtc cgg ggc atg gcc atc cgc tga gct ggc gat ctg gac tac gtt
arg val ser val pro val arg gly met ala ile arg)OPA(ala gly asp leu asp tyr val
961/321                                  991/331      SEQ ID NO: 904
ggt gta gaa aaa tcc tgc cgc ccg gac cct taa ggc tgg gac aat ttc tga tag cta ccc
gly val glu lys ser cys arg pro asp pro)OCH(gly trp asp asn phe)OPA AMB(leu pro
1021/341          SEQ ID NO: 905         1051/351      SEQ ID NO 906
cga cac agg agg tta cgg gat gag caa ttc gcg ccg ccg ctc act cag gtg gtc atg gtt
arg his arg arg leu arg asp glu gln phe ala pro pro leu thr gln val val met val
1081/361                                 1111/371
gct gag cgt gct ggc tgc cgt cgg gct ggg cct ggc cac ggc gcc ggc cca ggc ggc ccc
ala glu arg ala gly cys arg arg ala gly pro gly his gly ala gly pro gly gly pro
1141/381
gcc ggc ctt gtc gca gga ccg gtt
ala gly leu val ala gly pro val)
```

SEQ ID NOS:901-906

FIG.50C

Coding sequence Rv0125 predicted by Cole et al., 1998 (Nature 393:537-544) and containing seq50A:

```
1/1     SEQ ID NO: 907                    31/11
atg agc aat tcg cgc cgc cgc tca ctc agg  tgg tca tgg ttg ctg agc gtg ctg gct gcc
(Met ser asn ser arg arg arg ser leu arg  trp ser trp leu leu ser val leu ala ala
61/21    SEQ ID NO: 908                   91/31
gtc ggg ctg ggc ctg gcc acg gcg ccg gcc  cag gcg gcc ccg ccg gcc ttg tcg cag gac
val gly leu gly leu ala thr ala pro ala  gln ala ala pro pro ala leu ser gln asp
121/41                                    151/51
cgg ttc gcc gac ttc ccc gcg ctg ccc ctc  gac ccg tcc gcg atg gtc gcc caa gtg ggg
arg phe ala asp phe pro ala leu pro leu  asp pro ser ala met val ala gln val gly
181/61                                    211/71
cca cag gtg gtc aac atc aac acc aaa ctg  ggc tac aac aac gcc gtg ggc gcc ggg acc
pro gln val val asn ile asn thr lys leu  gly tyr asn asn ala val gly ala gly thr
241/81                                    271/91
ggc atc gtc atc gat ccc aac ggt gtc gtg  ctg acc aac aac cac gtg atc gcg ggc gcc
gly ile val ile asp pro asn gly val val  leu thr asn asn his val ile ala gly ala
301/101                                   331/111
acc gac atc aat gcg ttc agc gtc ggc tcc  ggc caa acc tac ggc gtc gat gtg gtc ggg
thr asp ile asn ala phe ser val gly ser  gly gln thr tyr gly val asp val val gly
361/121                                   391/131
tat gac cgc acc cag gat gtc gcg gtg ctg  cag ctg cgc ggt gcc ggt ggc ctg ccg tcg
tyr asp arg thr gln asp val ala val leu  gln leu arg gly ala gly gly leu pro ser
421/141                                   451/151
gcg gcg atc ggt ggc ggc gtc gcg gtt ggt  gag ccc gtc gtc gcg atg ggc aac agc ggt
ala ala ile gly gly gly val ala val gly  glu pro val val ala met gly asn ser gly
481/161                                   511/171
ggg cag ggc gga acg ccc cgt gcg gtg cct  ggc agg gtg gtc gcg ctc ggc caa acc gtg
gly gln gly gly thr pro arg ala val pro  gly arg val val ala leu gly gln thr val
541/181                                   571/191
cag gcg tcg gat tcg ctg acc ggt gcc gaa  gag aca ttg aac ggg ttg atc cag ttc gat
gln ala ser asp ser leu thr gly ala glu  glu thr leu asn gly leu ile gln phe asp
601/201                                   631/211
gcc gcg atc cag ccc ggt gat tcg ggc ggg  ccc gtc gtc aac ggc cta gga cag gtg gtc
ala ala ile gln pro gly asp ser gly gly  pro val val asn gly leu gly gln val val
661/221                                   691/231
ggt atg aac acg gcc gcg tcc gat aac ttc  cag ctg tcc cag ggt ggg cag gga ttc gcc
gly met asn thr ala ala ser asp asn phe  gln leu ser gln gly gly gln gly phe ala
721/241                                   751/251
att ccg atc ggg cag gcg atg gcg atc gcg  ggc cag atc cga tcg ggt ggg ggg tca ccc
ile pro ile gly gln ala met ala ile ala  gly gln ile arg ser gly gly gly ser pro
781/261                                   811/271
acc gtt cat atc ggg cct acc gcc ttc ctc  ggc ttg ggt gtt gtc gac aac aac ggc aac
thr val his ile gly pro thr ala phe leu  gly leu gly val val asp asn asn gly asn
841/281                                   871/291
ggc gca cga gtc caa cgc gtg gtc ggg agc  gct ccg gcg gca agt ctc ggc atc tcc acc
gly ala arg val gln arg val val gly ser  ala pro ala ala ser leu gly ile ser thr
901/301                                   931/311
ggc gac gtg atc acc gcg gtc gac ggc gct  ccg atc aac tcg gcc acc gcg atg gcg gac
gly asp val ile thr ala val asp gly ala  pro ile asn ser ala thr ala met ala asp
961/321                                   991/331
gcg ctt aac ggg cat cat ccc ggt gac gtc  atc tcg gtg acc tgg caa acc aag tcg ggc
ala leu asn gly his his pro gly asp val  ile ser val thr trp gln thr lys ser gly
1021/341                                  1051/351
ggc acg cgt aca ggg aac gtg aca ttg gcc  gag gga ccc ccg gcc tga
gly thr arg thr gly asn val thr leu ala  glu gly pro pro ala)OPA
```

SEQ ID NOS:907-908

FIG.50D

ORF according to Cole et al., 1998 (Nature 393:537-544) and containing Rv0125:

```
1/1    SEQ ID NO: 909                    31/11
tag aaa aat cct gcc gcc cgg acc ctt aag gct ggg aca att tct gat agc tac ccc gac
AMB(lys asn pro ala ala arg thr leu lys ala gly thr ile ser asp ser tyr pro asp
61/21   SEQ ID NO: 910                   91/31
aca gga ggt tac ggg atg agc aat tcg cgc cgc cgc tca ctc agg tgg tca tgg ttg ctg
thr gly gly tyr gly met ser asn ser arg arg arg ser leu arg trp ser trp leu leu
121/41                                  151/51
agc gtg ctg gct gcc gtc ggg ctg ggc ctg gcc acg gcg ccg gcc cag gcg gcc ccg ccg
ser val leu ala ala val gly leu gly leu ala thr ala pro ala gln ala ala pro pro
181/61                                  211/71
gcc ttg tcg cag gac cgg ttc gcc gac ttc ccc gcg ctg ccc ctc gac ccg tcc gcg atg
ala leu ser gln asp arg phe ala asp phe pro ala leu pro leu asp pro ser ala met
241/81                                  271/91
gtc gcc caa gtg ggg cca cag gtg gtc aac atc aac acc aaa ctg ggc tac aac aac gcc
val ala gln val gly pro gln val val asn ile asn thr lys leu gly tyr asn asn ala
301/101                                 331/111
gtg ggc gcc ggg acc ggc atc gtc atc gat ccc aac ggt gtc gtg ctg acc aac aac cac
val gly ala gly thr gly ile val ile asp pro asn gly val val leu thr asn asn his
361/121                                 391/131
gtg atc gcg ggc gcc acc gac atc aat gcg ttc agc gtc ggc tcc ggc caa acc tac ggc
val ile ala gly ala thr asp ile asn ala phe ser val gly ser gly gln thr tyr gly
421/141                                 451/151
gtc gat gtg gtc ggg tat gac cgc acc cag gat gtc gcg gtg ctg cag ctg cgc ggt gcc
val asp val val gly tyr asp arg thr gln asp val ala val leu gln leu arg gly ala
481/161                                 511/171
ggt ggc ctg ccg tcg gcg gcg atc ggt ggc ggc gtc gcg gtt ggt gag ccc gtc gtc gcg
gly gly leu pro ser ala ala ile gly gly gly val ala val gly glu pro val val ala
541/181                                 571/191
atg ggc aac agc ggt ggg cag ggc gga acg ccc cgt gcg gtg cct ggc agg gtg gtc gcg
met gly asn ser gly gly gln gly gly thr pro arg ala val pro gly arg val val ala
601/201                                 631/211
ctc ggc caa acc gtg cag gcg tcg gat tcg ctg acc ggt gcc gaa gag aca ttg aac ggg
leu gly gln thr val gln ala ser asp ser leu thr gly ala glu glu thr leu asn gly
661/221                                 691/231
ttg atc cag ttc gat gcc gcg atc cag ccc ggt gat tcg ggg ccc gtc gtc aac ggc
leu ile gln phe asp ala ala ile gln pro gly asp ser gly gly pro val val asn gly
721/241                                 751/251
cta gga cag gtg gtc ggt atg aac acg gcc gcg tcc gat aac ttc cag ctg tcc cag ggt
leu gly gln val val gly met asn thr ala ala ser asp asn phe gln leu ser gln gly
781/261                                 811/271
ggg cag gga ttc gcc att ccg atc ggg cag gcg atg gcg atc gcg ggc cag atc cga tcg
gly gln gly phe ala ile pro ile gly gln ala met ala ile ala gly gln ile arg ser
841/281                                 871/291
ggt ggg ggg tca ccc acc gtt cat atc ggg cct acc gcc ttc ctc ggc ttg ggt gtt gtc
gly gly gly ser pro thr val his ile gly pro thr ala phe leu gly leu gly val val
901/301                                 931/311
gac aac aac ggc aac ggc gca cga gtc caa cgc gtg gtc ggg agc gct ccg gcg gca agt
asp asn asn gly asn gly ala arg val gln arg val val gly ser ala pro ala ala ser
961/321                                 991/331
ctc ggc atc tcc acc ggc gac gtg atc acc gcg gtc gac ggc gct ccg atc aac tcg gcc
leu gly ile ser thr gly asp val ile thr ala val asp gly ala pro ile asn ser ala
1021/341                                1051/351
acc gcg atg gcg gac gcg ctt aac ggg cat cat ccc ggt gac gtc atc tcg gtg acc tgg
thr ala met ala asp ala leu asn gly his his pro gly asp val ile ser val thr trp
1081/361                                1111/371
caa acc aag tcg ggc ggc acg cgt aca ggg aac gtg aca ttg gcc gag gga ccc ccg gcc
gln thr lys ser gly gly thr arg thr gly asn val thr leu ala glu gly pro pro ala)
1141/381
tga
OPA
```

SEQ ID NOS:909-910

FIG.50E

Experiment of molecular hybridization of a specific to DP428 on the genomic DNA of various mycobacterial species 1: *M. tuberculosis* 2: *M. bovis* 3: BCG 4: *M. africanum* 5: cancelled 6: *M. fortuitum* 7: *M. simiae* 8: *M. avium* 9: *M. chelonae* 10: *M. flavescens* 11: *M. gordonae* 12: *M. marinum* 13: *M. kansasii*

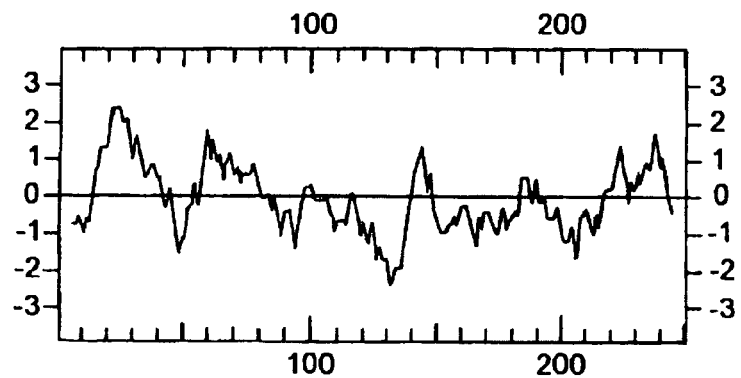
FIG. 56
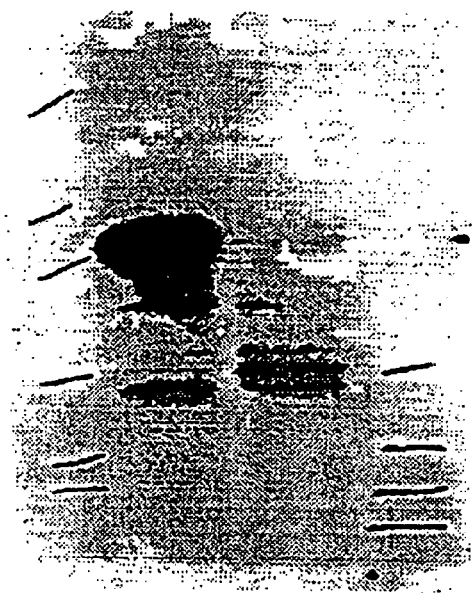 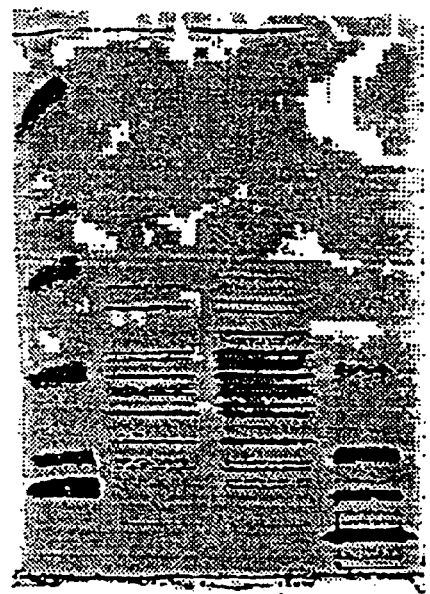
FIG. 57A          FIG. 57B

POLYPEPTIDE NUCLEIC SEQUENCES EXPORTED FROM MYCOBACTERIA, VECTORS COMPRISING SAME AND USES FOR DIAGNOSING AND PREVENTING TUBERCULOSIS

This application is a continuation of application Ser. No. 09/485,536, which is a national stage of PCT/FR98/01813, filed Aug. 14, 1998, and is incorporated herein by reference. This application claims priority under 35 U.S.C. § 119 to FR 97/10,404, filed Aug. 14, 1997, and FR 97/11,325, filed Sep. 11, 1997.

The subject of the invention is novel recombinant screening, cloning and/or expression vectors which replicate in mycobacteria. Its subject is also a set of sequences encoding exported polypeptides which are detected by fusions with alkaline phosphatase and whose expression is regulated (induced or repressed) or constitutive during the ingestion of mycobacteria by macrophages. The invention also relates to a polypeptide, called DP428, of about 12 kD which corresponds to an exported protein found in mycobacteria belonging to the *Mycobacterium tuberculosis* complex. The invention also relates to a polynucleotide comprising a sequence encoding this polypeptide. It also relates to the use of the polypeptide or of fragments thereof and of the polynucleotides encoding the latter (or alternatively the polynucleotides complementary to the latter) for the production of means for detecting in vitro or in vivo the presence of a *mycobacterium* belonging to the *Mycobacterium tuberculosis* complex in a biological sample or for the detection of reactions of the host infected with these bacterial species. The invention finally relates to the use of the polypeptide or of fragments thereof as well as of the polynucleotides encoding the latter as means intended for the preparation of an immunogenic composition which is capable of inducing an immune response directed against the mycobacteria belonging to the *Mycobacterium tuberculosis* complex, or of a vaccine composition for the prevention and/or treatment of infections caused by mycobacteria belonging to said complex, in particular tuberculosis.

SEQUENCE LISTING

The instant application contains a "lengthy" Sequence Listing which has been submitted via CD-R In lieu of a printed paper copy, and is hereby incorporated by reference in its entirety. Said CD-R, recorded on May 14, 2002. contains a 1.209 MB sequence listing file.

The aim of the present invention is also to use these sequences (polypeptide and polynucleotide sequences) as target for the search for novel inhibitors of the growth and multiplication of mycobacteria and of their maintenance in the host, it being possible for these inhibitors to serve as antibiotics.

The genus *Mycobacterium*, which comprises at least 56 different species, includes major human pathogens such as *M. leprae* and *M. tuberculosis*, the agents responsible for leprosy and tuberculosis, which remain serious public health problems worldwide.

Tuberculosis continues to be a public health problem in the world. At present, this disease is the cause of 2 to 3 million deaths in the world and about 8 million new cases are observed each year (Bouvet, 1994). In developed countries, *M. tuberculosis* is the most common cause of mycobacteria infections. In France, about 10,000 new cases appear per year and, among the notifiable diseases, it is tuberculosis which comprises the highest number of cases.

Vaccination with BCG (Bacille Calmette-Guérin), an avirulent strain which is derived from *M. bovis* and which is widely used as a vaccine against tuberculosis, is far from being effective in all populations. This efficacy varies from about 80% in western countries such as England, to 0% in India (results of the last vaccination trial in Chingleput., published in 1972 in Indian J. Med. Res.). Furthermore, the appearance of *M. tuberculosis* strains which are resistant to antituberculars and the increased risk in immunosuppressed patients, patients suffering from AIDS, of developing tuberculosis, make the development of rapid, specific and reliable methods for the diagnosis of tuberculosis and the development of novel vaccines necessary. For example, an epidemiological study carried out in Florida, and of which the results were published in 1993 in AIDS therapies, showed that 10% of the AIDS patients are affected by tuberculosis at the time of the AIDS diagnosis or 18 months before it. In these patients, tuberculosis appears in 60% of cases in a form which is disseminated and therefore nondetectable by conventional diagnostic criteria such as pulmonary radiography or the analysis of sputum.

Currently, a certainty on the diagnosis provided by the detection of bacilli which can be cultured in a sample obtained from a patient is obtained in only less than half of the tuberculosis cases, even in the case of pulmonary tuberculosis. The diagnosis of tuberculosis and of the other related mycobacteria is therefore difficult to carry out for various reasons: mycobacteria are often present in a small quantity, their generation time is very long (24 h for *M. tuberculosis*) and they are difficult to culture (Bates et al., 1986).

Other techniques can be used in clinical medicine to identify a mycobacterial infection:

a) The direct identification of microorganisms under a microscope; this technique is rapid, but does not allow the identification of the mycobacterial species observed and lacks sensitivity (Bates, 1979).

Cultures, when they are positive, have a specificity approaching 100% and allow the identification of the mycobacterial species isolated; however, as specified above, the growth of mycobacteria in vitro is long (can only be carried out in 3 to 6 weeks of repeated cultures (Bates, 1979; Bates et al., 1986)) and expensive.

b) Serological techniques are found to be useful under certain conditions, but their use is sometimes limited by their low sensitivity and/or specificity (Daniel et al., 1987).

c) The presence of mycobacteria in a biological sample can also be determined by molecular hybridization with DNA or RNA using oligonucleotide probes which are specific for the sequences tested for (Kiehn et al., 1987; Roberts et al., 1987; Drake et al., 1987). Several studies have shown the advantage of this technique for the diagnosis of mycobacterial infections. The probes used consist of DNA, ribosomal RNA or DNA fragments from mycobacteria which are obtained from gene banks. The principle of these techniques is based on the polymorphism of the nucleotide sequences of the fragments used or on the polymorphism of the adjacent regions. In all cases, they require the use of cultures and are not directly applicable to biological samples.

The low quantity of mycobacteria present in a biological sample and consequently the low quantity of target DNA to be detected in this sample can require the use of a specific amplification in vitro of the target DNA before its detection with the aid of the nucleotide probe and using in vitro amplification techniques such as PCR (polymerase chain reaction). The specific amplification of the DNA by the PCR technique can constitute the first stage of a method for detecting the presence of a mycobacterial DNA in a biological sample, the actual detection of the amplified DNA being carried out in a second stage with the aid of an oligonucleotide probe capable of specifically hybridizing with the amplified DNA.

A test for the detection of mycobacteria belonging to the *Mycobacterium tuberculosis* complex, by sandwich hybridization (test using a capture probe and a detection probe) was described by Chevrier et al. in 1993. The *Mycobacterium tuberculosis* complex is a group of mycobacteria which comprises *M. bovis*-BCG, *M. bovis, M. tuberculosis, M. africanum* and *M. microti.*

A method for the detection of low quantities of mycobacteria, belonging to the tuberculosis complex, by gene amplification and direct hybridization on biological samples has been developed. Said method uses the insertion sequence IS6110 (European Patent EP 0,490,951 B1). Thierry et al. described in 1990 a sequence which is specific to the *Mycobacterium tuberculosis* complex and which is called IS6110. Some authors have proposed specifically amplifying the DNA obtained from *Mycobacterium* using nucleic primers in an amplification method, such as the polymerase chain reaction (PCR). Patel et al. described in 1990 the use of several nucleic primers chosen from a sequence known as a probe in the identification of *M. tuberculosis*. However, the length of the fragments obtained using these primers was different from the expected theoretical length and several fragments of variable size were obtained. Furthermore, the authors observed the absence of hybridization of the amplified products with the plasmid which served to determine the primers. These results indicate that these primers might not be appropriate in the detection of the presence of *M. tuberculosis* in a biological sample and confirm the critical nature of the choice of the primers. The same year, J. L. Guesdon and D. Thierry described a method for the detection of *M. tuberculosis*, having a high sensitivity, by amplification of an *M. tuberculosis* DNA fragment located within the IS6110 sequence (European Patent EP 461,045) with the aid of primers generating amplified DNA fragments of constant length, even when the choice of the primers led to the amplification of long fragments (of the order of 1000 to 1500 bases) where the risk of interruption of the polymerization is high because of the effects of the secondary structure of the sequence. Other primers specific for the IS6110 sequence are described in European Patent No. EP-0,490,951.

The inventors have shown (unpublished results) that some clinical isolates of *Mycobacterium tuberculosis* lacked the insertion sequence IS6110 and could therefore not be detected with the aid of oligonucleotides specific for this sequence which could thus lead to false-negative diagnostic results. These results confirm a similar observation made by Yuen et al. in 1993. The impossibility of detecting these pathogenic strains which are potentially present in a biological sample collected from a patient is thus likely to lead to diagnostic difficulties or even to diagnostic errors. The availability of several sequences specific for the *tubercule bacillus,* within which primers appropriate for amplification will be chosen, is important. The DP428 sequence described here may be used.

*M. bovis* and *M. tuberculosis,* the causative agents of tuberculosis, are facultative intracellular bacteria.

These agents have developed mechanisms to ensure their survival and their replication inside macrophage, one of the cell types which is supposed to eradicate invasion by microorganisms. These agents are capable of modulating the normal development of their phagosome and of preventing them from becoming differentiated into an acidic compartment rich in hydrolase (Clemens, 1979; Clemens et al., 1996; Sturgill-Koszycki et al., 1994 and Xu et al., 1994). However, this modulation is only possible if the bacterium is alive inside the phagosome, suggesting that compounds which are actively synthesized and/or secreted inside the cell are part of this mechanism. Exported proteins are probably involved in this mechanism. Despite major health problems linked to these pathogenic organisms, little is known on their exported and/or secreted proteins. SDS-PAGE analyses of *M. tuberculosis* culture filtrate show at least 30 secreted proteins (Altschul et al., 1990; Nagal et al., 1991 and Young et al., 1992). Some of them have been characterized, their genes cloned and sequenced (Borremans et al., 1989; Wiker et al., 1992 and Yamaguchi et al., 1989). Others, although being immunodominant antigens of major importance for inducing a protective immunity (Anderson et al., 1991 and Orme et al., 1993), have not been completely identified. In addition, it is probable that many exported proteins remain attached to the cell membrane and are consequently not present in the culture supernatants. It has been shown that the proteins located at the outer surface of various pathogenic bacteria, such as the 103 kDa invasin of *Yersina Pseudotuberculosis* (Isberg et al., 1987) or the 80 kDa internalin of *Listeria monocytogenes* (Gaillard et al., 1991 and Dramsi et al., 1997) play an important role in the interactions with the host cells and, consequently, in the pathogenicity as well as in the induction of protective responses. Thus, a protein which is bound to the membrane would be important for the *M. tuberculosis* infection as well as for the induction of a protective response against this infection. These proteins could certainly be of interest for the preparation of vaccines.

Recently, the adaptation, to mycobacteria, of a genetic methodology for the identification and the phenotypic selection of-export proteins has been described (Lim et al., 1995). This method uses *E. coli* periplasmic alkaline phosphatase (PhoA). A plasmid vector was constructed which allows the fusion of genes between a truncated PhoA gene and genes encoding exported proteins (Manoil et al., 1990).

Using this method, it has been possible to identify an *M. tuberculosis* gene (erp (Berthet et al., 1995)) exhibiting homologies with a 28 kDa exported protein of *M. leprae,* which is a frequent target of humoral responses of the lepromatous form of leprosy. A protein having amino acid motifs which are characteristic of plant desaturase (des) has also been characterized by the technique of fusion with PhoA.

However, this genetic method for identifying exported proteins does not make it possible to easily evaluate the intracellular expression of the corresponding genes. Such an evaluation is of crucial importance both for selecting good candidate vaccines and for understanding the interactions between bacteria and their host cells. The induction of the expression of virulence factor through pathogenic target cell contact has been described. It is the case, for example, for the *Yersinia pseudotuberculosis* Yops virulence factors (Petersson et al., 1996). *Shigella,* upon contact with the target cells, releases the Ipa proteins into the culture medium, and *Salmonella* synthesizes novel surface structures.

Taking into account the preceding text, a great need currently exists for developing novel vaccines against pathogenic microbacteria as well as novel specific, reliable and rapid diagnostic tests. These developments require the designing of even more efficient specific tools which make it possible, on the one hand, to isolate or to obtain sequences of novel specific, in particular immunogenic, polypeptides, and, on the other hand, to better understand the mechanism of the interactions between bacteria and their host cells such as in particular the induction of the expression of virulence factor. This is precisely the object of the present invention.

The inventors have defined and produced, for this purpose, novel vectors allowing the screening, cloning and/or expression of mycobacterial DNA sequences so as to identify, among these sequences, nucleic acids encoding proteins of interest, preferably exported proteins, which may be located on the bacterial membrane, and/or secreted proteins, and to identify among these sequences those which are induced or repressed during infection (intracellular growth).

DESCRIPTION

The present invention describes the use of the reporter gene phoA in mycobacteria. It makes it possible to identify systems for expression and export in a mycobacterial context. Many genes are only expressed in such a context, which shows the advantage of the present invention. During the cloning of DNA segments of strains of the *M. tuberculosis* complex fused with phoA into another *mycobacterium* such as *M. smegmatis,* the beginning of the gene, its regulatory regions and its regulator will be cloned, which will make it possible to observe a regulation. If this regulation is positive, the cloning of the regulator will constitute an advantage for observing the expression and the export.

In the context of the invention, *mycobacterium* is understood to mean all the mycobacteria belonging to the various species listed by Wayne L. G. and Kubica G. P. (1980). Family Mycobacteriaceae in Bergey's manual of systematic bacteriology, J. P. Butler Ed. (Baltimore USA: Williams and Wilkins P. 1436-1457).

In some cases, the cloned genes are subjected in their original host to a negative regulation which makes the observation of the expression and of the export difficult in the original host. In this case, the cloning of the gene in the absence of its negative regulator, into a host not containing it, will constitute an advantage.

The invention also relates to novel mycobacterial polypeptides and to novel mycobacterial polynucleotides which may have been isolated by means of the preceding vectors and which are capable of entering into the preparation of compositions for the detection of a microbacterial infection, or for the protection against an infection caused by mycobacteria or for the search for inhibitors as is described above for DP428.

The subject of the invention is therefore a recombinant screening, cloning and/or expression vector, characterized in that it replicates in mycobacteria and in that it contains:

1) a replicon which is functional in mycobacteria;
2) a selectable marker;
3) a reporter cassette comprising:

a) a multiple cloning site (polylinker), b) optionally a transcription terminator which is active in mycobacteria, upstream of the polylinker, c) a coding nucleotide sequence which is derived from a gene encoding a protein expression, export and/or secretion marker, said nucleotide sequence lacking its initiation codon and its regulatory sequences, and d) a coding nucleotide sequence derived from a gene encoding a marker for the activity of promoters which are contained in the same fragment, said nucleotide sequence lacking its initiation codon. Optionally, the recombinant vector also contains a replicon which is functional in *E. coli.*

Preferably, the export and/or secretion marker is placed in the same orientation as the promoter activity marker.

Preferably, the recombinant screening vector according to the invention comprises, in addition, a transcription terminator placed downstream of the promoter activity marker, which is likely to allow the production of short transcripts which are found to be more stable and which consequently allow a higher level of expression of the products of translation.

The export and/or secretion marker is a nucleotide sequence whose expression, followed by export and/or secretion, depends on the regulatory elements which control its expression.

"Sequences or elements for regulating the expression of the production of polypeptides and its location" is understood to mean a transcriptional promoter sequence, a sequence comprising the ribosome-binding site (RBS), the sequences responsible for export and/or secretion such as the sequence termed signal sequence.

A first advantageous export and/or expression marker is a coding sequence derived from the phoA gene. Where appropriate, it is truncated such that the alkaline phosphatase activity is nevertheless capable of being restored when the truncated coding sequence is placed under the control of a promoter and of appropriate regulatory elements.

Other exposure, export and/or secretion markers may be used. There may be mentioned, by way of examples, a sequence of the gene for β-agarase, for the nuclease of a staphylococcus or for a β-lactamase.

Among the advantageous markers for the activity of promoters which are contained in the same fragment, a coding sequence derived from the firefly luciferase luc gene, provided with its initiation codon, is preferred.

Other markers for the activity of promoters which are contained in the same fragment may be used. There may be mentioned, by way of examples, a sequence of the gene for GFP (Green Fluorescent Protein).

The transcription terminator should be functional in mycobacteria. An advantageous terminator is, in this regard, the T4 coliphage terminator (tT4). Other appropriate terminators for carrying out the invention may be isolated using the technique presented in the examples, for example by means of an "omega" cassette (Prentki et al., 1984).

A vector which is particularly preferred for carrying out the invention is a plasmid chosen from the following plasmids which have been deposited at the CNCM (Collection Nationale de Cultures de Microorganismes, 25 rue de Docteur Roux, 75724 Paris cedex 15, France):

a) pJVEDa which was deposited at the CNCM under the No. I-1797, on Dec. 12, 1996, b) pJVEDb which was deposited at the CNCM under the No. I-1906, on 25 Jul. 1997, c) pJVEDc which was deposited at the CNCM under the No. I-1799, on Dec. 12, 1996.

For the selection or the identification of mycobacterial nucleic acid sequences encoding polypeptides which are capable of being incorporated into immunogenic or antigenic compositions for the detection of an infection, or which are capable of inducing or repressing a mycobacterial virulence factor, the vector of the invention will comprise, at one of the multiple cloning sites of the polylinker, a nucleotide sequence of a *mycobacterium* in which the detection is carried out of the presence of sequences corresponding to exported and/or secreted polypeptides which may be induced or repressed during the infection, or alternatively expressed or produced constitutively, their associated promoter and/or regulatory sequences which are capable of allowing or promoting the export and/or the secretion of said polypeptides of interest, or all or part of the genes of interest encoding said polypeptides.

Preferably, this sequence is obtained by physical fragmentation or by enzymatic digestion of the genomic DNA or of the DNA which is complementary to an RNA of a *mycobacterium*, preferably *M. tuberculosis* or chosen from *M. africanum, M. bovis, M. avium* or *M. leprae*.

The vectors of the invention may indeed also be used to determine the presence of sequences of interest, preferably corresponding to exported and/or secreted proteins, and/or capable of being induced or repressed or produced constitutively during the infection, in particular during phagocytosis by the macrophages, and, according to what was previously disclosed, in mycobacteria such as *M. africanum, M. bovis, M. avium* or *M. leprae* whose DNA or cDNA will have been treated by physical fragmentation or with defined enzymes.

According to a first embodiment of the invention, the enzymatic digesion of the genomic DNA or of the complementary DNA is carried out using *M. tuberculosis.*

Preferably, this DNA is digested with an enzyme such as Sau3A, BclI or BglII.

Other digestive enzymes such as ScaI, ApaI, SacII or KpnI or alternatively nucleases or polymerases can naturally be used as long as they allow the production of fragments whose ends can be inserted into one of the cloning sites of the polylinker of the vector of the invention.

Where appropriate, the digestions with various enzymes will be carried out simultaneously.

Recombinant vectors which are preferred for carrying out the invention are chosen from the following recombinant vectors which have been deposited at the CNCM:

a) p6D7 which was deposited on 28 Jan. 1997 at the CNCM under the No. I-1814, b) p5A3 which was deposited on 28 Jan. 1997 at the CNCM under the No. I-1815, c) p5F6 which was deposited on 28 Jan. 1997 at the CNCM under the No. I-1816, d) p2A29 which was deposited on 28 Jan. 1997 at the CNCM under the No. I-1817, e) pDP428 which was deposited on 28 Jan. 1997 at the CNCM under the No. I-1818, f) p5B5 which was deposited on 28 Jan. 1997 at the CNCM under the No. I-1819, g) p1C7 which was deposited on 28 Jan. 1997 at the CNCM under the No. I-1820, h) p2D7 which was deposited on 28 Jan. 1997 at the CNCM under the No. I-1821, i) p1B7 which was deposited on 31 Jan. 1997 at the CNCM under the No. I-1843, j) pJVED/*M. tuberculosis* which was deposited on 25 Jul. 1997 at the CNCM under the No. I-1907, k) pM1C25 which was deposited on 4 Aug. 1998 at the CNCM under the No. I-2062.

Among those which are most preferred, the recombinant vector pDP428 which was deposited on 28 Jan. 1997 at the CNCM under the No. I-1818, and the vector pM1C25 which was deposited on 4 Aug. 1998 at the CNCM under the No. I-2062 are preferred.

The subject of the invention is also a method of screening nucleotide sequences derived from mycobacteria in order to determine the presence of sequences corresponding to exported and/or secreted polypeptides which may be induced or repressed during the infection, their associated promoter and/or regulatory sequences which are capable in particular of allowing or promoting the export and/or secretion of said polypeptides of interest, or all or part of genes of interest encoding said polypeptides, characterized in that it uses a recombinant vector according to the invention.

The invention also relates to a method of screening, according to the invention, characterized in that it comprises the following steps:

a) physical fragmentation of the mycobacterial DNA sequences or their digestion with at least one defined enzyme and recovery of the fragments obtained;

b) insertion of the fragments obtained in step a) into a cloning site, which is compatible, where appropriate, with the enzyme of step a), of the polylinker of a vector according to the invention;

c) if necessary, amplification of said fragments contained in the vector, for example by replication of the latter after insertion of the vector thus modified into a defined cell, preferably *E. coli;* d) transformation of the host cells with the vector amplified in step c), or in the absence of amplification, with the vector of step b);

e) culture of the transformed host cells in a medium allowing the detection of the export and/or secretion marker, and/or of the promoter activity marker which is contained in the vector;

f) detection of the host cells which are positive (positive colonies) for the expression of the export and/or secretion marker, and/or of the promoter activity marker;

g) isolation of the DNA from the positive colonies and insertion of this DNA into a cell which is identical to that in step c);

h) selection of the inserts contained in the vector, allowing the production of clones which are positive for the export and/or secretion marker, and/or for the promoter activity marker;

i) isolation and characterization of the mycobacterial DNA fragments contained in these inserts.

In one of the preferred embodiments of the screening method according to the invention, the host cells, detected in step f), which are positive for the export and/or secretion marker are, optionally in a second stage, tested for the capacity of the selected nucleotide insert to stimulate the expression of the promoter activity marker when said host cells are phagocytosed by macrophage-type cells.

More specifically, the stimulation of the expression of the promoter activity marker in host cells placed in axenic culture (host cells alone in culture) is compared with the stimulation of the expression of the promoter activity marker in host cells cultured in the presence of macrophages and which are thus phagocytosed by the latter.

The selection of host cells which are positive for the promoter activity marker can be carried out immediately after step e) of the method of screening described above, or alternatively after any one of steps f), g), h) or i), that is to say once the host cells have been positively selected for the export and/or selection marker.

The use of this method allows the construction of DNA libraries comprising sequences corresponding to polypeptides which are capable of being exported and/or secreted, and/or which are capable of being induced or repressed during the infection when they are produced inside recombinant mycobacteria. Step i) of the method may comprise a step for sequencing the inserts selected.

Preferably, in the method according to the invention, the vector used is chosen from the plasmids pJVEDa (CNCM, No. I-1797), pJVEDb (CNCM, No. I-1906), pJVEDc (CNCM, No. I-1799) or pJVED/*M. tuberculosis* (CNCM, No. I-1907), and the digestion of the mycobacterial DNA sequences is carried out by means of the enzyme Sau3A.

According to a preferred embodiment of the invention, the method of screening is characterized in that the mycobacterial sequences are derived from a pathogenic *mycobacterium*, for example from *M. tuberculosis, M. bovis, M. avium, M. africanum* or *M. leprae*.

The invention also comprises a library of genomic DNA or of cDNA which is complementary to mycobacterial mRNA, characterized in that it is obtained by a method comprising steps a) and b) or a), b) and c) of the preceding method according to the invention, preferably a library of genomic DNA or of cDNA which is complementary to mRNA of pathogenic mycobacteria, preferably of mycobacteria belonging to the *Mycobacterium tuberculosis* complex group, preferably of *Mycobacterium tuberculosis*.

In the present invention, "nucleic sequences" or "amino acid sequences" are understood to designate SEQ ID No. X to SEQ ID No. Y, where X and Y may independently represent a number or an alphanumeric character, respectively the set of nucleic sequences or the set of amino acid sequences represented by figures X to Y, ends included.

For example, the nucleic sequences or the amino acid sequences SEQ ID NOS: 1-87 are respectively the nucleic sequences or the amino acid sequences represented by FIGS. 1 to 4N.

The subject of the invention is also the nucleotide sequences of mycobacteria or comprising nucleotide sequences of mycobacteria selected after carrying out the method according to the invention which is described above.

Preferably, said *mycobacterium* is chosen from *M. tuberculosis, M. bovis, M. africanum, M. avium, M. leprae, M. paratuberculosis, M. kansassi* or *M. xenopi*.

The nucleotide sequences of mycobacteria or comprising a mycobacterial nucleotide sequence are preferred, said mycobacterial nucleotide sequence being chosen from the sequences of mycobacterial DNA fragments having the nucleic sequences SEQ ID NOS: 1, 8, 14, 25, 31, 33, 35, 41, 46, 52, 56, 62, 64, 67, 69, 72, 74, 76, 78, 81, 84, 86, 88, 90, 92, 96, 98, 100, 104, 106, 108, 110, 113, 119, 122, 128, 133, 137, 139,141, 143, 145, 148, 150, 152, 154, 156, 158, 160, 162, 165, 169, 177, 184, 189, 195, 200, 202, 206, 209, 211, 213, 217, 220, 225, 228, 238, 246, 250, 255, 258, 260, 262, 268, 274, 278, 280, 282, 284, 286, 288, 290, 297, 310, 317, 321, 323, 325, 327, 331, 333, 335, 337, 339, 346, 347, 353, 357, 359, 361, 364, 368, 371, 374, 380, 383, 385, 387, 389, 393, 395, 397, 399, 403, 405, 407, 410, 412, 419, 421, 426, 429, 431, 433, 437, 441, 447, 452, 456, 459, 461, 463, 469, 472, 474, 476, 482, 485, 487, 489, 495, 497, 501, 505, 510, 516, 519, 522, 530, 534, 537, 544, 546, 550, 552, 554, 556, 558, 564, 569, 571, 573, 576, 580, 584, 586, 588, 590, 594, 596, 598, 600, 604, 608, 610, 612, 614, 616, 618, 620, 622, 624, 626, 629, 631, 633, 635, 640, 647, 649, 651, 653, 657, 660, 662, 664, 666, 669, 674, 676, 678, 683, 686, 691, 693, 695, 697, 702, 717, 728, 733, 736, 739, 741, 743, 746, 752, 755, 757, 759, 761, 764, 767, 769, 771, 784, 794, 805, 807, 809, 811, 813, 817, 821, 823, 825, 827, 831, 833, 835, 837, 839, 842, 844, 846, 848, 864, 878, 883, 885, 887, 895, 901, 907, and 909, which are represented respectively by FIGS. 1 to 24C (plates 1 to 150), by FIGS. 27A to 27C (plates 152 to 154), by FIG. 29 (plate 156) and by FIGS. 31A to 50F (plates 158 to 275).

According to a specific embodiment of the invention, preferred mycobacterial sequences are, for example, the mycobacterial DNA fragments having the sequence SEQ ID NO: 1, which is contained in the vector pDP428 (CNCM, No. I-1818), SEQ ID NO: 41, which is contained in the vector p6D7 (CNCM, No. I-1814), SEQ ID NOS: 88 and 96, which are contained in the vector p5F6 (CNCM, No. I-1816), SEQ ID NO: 110, which is contained in the vector p2A29 (CNCM, No. I-1817), SEQ ID NO: 122, which is contained in the vector p5B5 (CNCM, No. I-1819), SEQ ID NOS: 137 and 143, which are contained in the vector p1C7 (CNCM, No. I-1820), SEQ ID NO: 158, which is contained in the vector p2D7 (CNCM, No. I-1821), SEQ ID NO: 165, which is contained in the vector p1 B7 (CNCM, No. I-1843), SEQ ID NO: 530, which is contained in the vector p5A3 (CNCM, No. I-1815), or SEQ ID NO: 544, which is contained in the vector pM1C25 (CNCM, No. I-2062.

The invention also relates to a nucleic acid comprising the entire open reading frame of one of the nucleotide sequences according to the invention, in particular one of the sequences SEQ ID NOS: 1, 8, 14, 25, 31, 33, 35, 41, 46, 52, 56, 62, 64, 67, 69, 72, 74, 76, 78, 81, 84, 86, 88, 90, 92, 96, 98, 100, 104, 106, 108, 110, 113, 119, 122, 128, 133, 137, 139, 141, 143, 145, 148, 150, 152, 154, 156, 158, 160, 162, 165, 169, 177, 184, 189, 195, 200, 202, 206, 209, 211, 213, 217, 220, 225, 228, 238, 246, 250, 255, 258, 260, 262, 268, 274, 278, 280, 282, 284, 286, 288, 290, 297, 310, 317, 321, 323, 325, 327, 331, 333, 335, 337, 339, 346, 347, 353, 357, 359, 361, 364, 368, 371, 374, 380, 383, 385, 387, 389, 393, 395, 397, 399, 403, 405, 407, 410, 412, 419, 421, 426, 429, 431, 433, 437, 441, 447, 452, 456, 459, 461, 463, 469, 472, 474, 476, 482, 485, 487, 489, 495, 497, 501, 505, 510, 516, 519, 522, 530, 534, 537, 544, 546, 550, 552, 554, 556, 558, 564, 569, 571, 573, 576, 580, 584, 586, 588, 590, 594, 596, 598, 600, 604, 608, 610, 612, 614, 616, 618, 620, 622, 624, 626, 629, 631, 633, 635, 640, 647, 649, 651, 653, 657, 660, 662, 664, 666, 669, 674, 676, 678, 683, 686, 691, 693, 695, 697, 702, 717, 728, 733, 736, 739, 741, 743, 746, 752, 755, 757, 759, 761, 764, 767, 769, 771, 784, 794, 805, 807, 809, 811, 813, 817, 821, 823, 825, 827, 831, 833, 835, 837, 839, 842, 844, 846, 848, 864, 878, 883, 885, 887, 895, 901, 907, and 909 according to the invention.

Said nucleic acid may be isolated, for example, in the following manner:

a) preparation of a cosmid library from the *M. tuberculosis* DNA, for example according to the technique described by Jacobs et al., 1991;

b) hybridization of all or part of a probe nucleic acid having the sequences chosen, for example, from SEQ ID NOS: 1, 8, 14, 25, 31, 33, 35, 41, 46, 52, 56, 62, 64, 67, 69, 72, 74, 76, 78, 81, 84, 86, 88, 90, 92, 96, 98, 100, 104, 106, 108, 110, 113, 119, 122, 128, 133, 137, 139, 141, 143, 145, 148, 150, 152, 154, 156, 158, 160, 162, 165, 169, 177, 184, 189, 195, 200, 202, 206, 209, 211, 213, 217, 220, 225, 228, 238, 246, 250, 255, 258, 260, 262, 268, 274, 278, 280, 282, 284, 286, 288, 290, 297, 310, 317, 321, 323, 325, 327, 331, 333, 335, 337, 339, 346, 347, 353, 357, 359, 361, 364, 368, 371, 374, 380, 383, 385, 387, 389, 393, 395, 397, 399, 403, 405, 407, 410, 412, 419, 421, 426, 429, 431, 433, 437, 441, 447, 452, 456, 459, 461, 463, 469, 472, 474, 476, 482, 485, 487, 489, 495, 497, 501, 505, 510, 516, 519, 522, 530, 534, 537, 544, 546, 550, 552, 554, 556, 558, 564, 569, 571, 573, 576, 580, 584, 586, 588, 590, 594, 596, 598, 600, 604, 608, 610, 612, 614, 616, 618, 620, 622, 624, 626, 629, 631, 633, 635, 640, 647, 649, 651, 653, 657, 660, 662, 664, 666, 669, 674, 676, 678, 683, 686, 691, 693, 695, 697, 702, 717, 728, 733, 736, 739, 741, 743, 746, 752, 755, 757, 759, 761, 764, 767, 769, 771, 784, 794, 805, 807, 809, 811, 813, 817, 821, 823, 825, 827, 831, 833, 835, 837, 839, 842, 844, 846, 848, 864, 878, 883, 885, 887, 895, 901, 907, 909, with the cosmids of the library previously prepared in step a);

c) selection of the cosmids hybridizing with the probe nucleic acid of step b);

d) sequencing of the DNA inserts of the clones selected in step c) and identification of the complete open reading frame;

e) where appropriate, cloning of the inserts sequenced in step d) into an appropriate expression and/or cloning vector.

The nucleic acids comprising the entire open reading frame of the sequences SEQ ID NOS: 1, 8, 14, 25, 31, 33, 35, 41, 46, 52, 56, 62, 64, 67, 69, 72, 74, 76, 78, 81, 84, 86, 88, 90, 92, 96, 98, 100, 104, 106, 108, 110, 113, 119, 122, 128, 133, 137, 139, 141, 143, 145, 148, 150, 152, 154, 156, 158, 160, 162, 165, 169, 177, 184, 189, 195, 200, 202, 206, 209, 211, 213, 217, 220, 225, 228, 238, 246, 250, 255, 258, 260, 262, 268, 274, 278, 280, 282, 284, 286, 288, 290, 297, 310, 317, 321, 323, 325, 327, 331, 333, 335, 337, 339, 346, 347, 353, 357, 359, 361, 364, 368, 371, 374, 380, 383, 385, 387, 389, 393, 395, 397, 399, 403, 405, 407, 410, 412, 419, 421, 426, 429, 431, 433, 437, 441, 447, 452, 456, 459, 461, 463, 469, 472, 474, 476, 482, 485, 487, 489, 495, 497, 501, 505, 510, 516, 519, 522, 530, 534, 537, 544, 546, 550, 552, 554, 556, 558, 564, 569, 571, 573, 576, 580, 584, 586, 588, 590, 594, 596, 598, 600, 604, 608, 610, 612, 614, 616, 618, 620, 622, 624, 626, 629, 631, 633, 635, 640, 647, 649, 651, 653, 657, 660, 662, 664, 666, 669, 674, 676, 678, 683, 686, 691, 693, 695, 697, 702, 717, 728, 733, 736, 739, 741, 743, 746, 752, 755, 757, 759, 761, 764, 767, 769, 771, 784, 794, 805, 807, 809, 811, 813, 817, 821, 823, 825, 827, 831, 833, 835, 837, 839, 842, 844, 846, 848, 864, 878, 883, 885, 887, 895, 901, 907, 909, are among the preferred nucleic acids.

The present invention makes it possible to determine a gene fragment encoding an exported polypeptide. Comparison with the genome sequence published by Cole et al. (Cole et al., 1998, Nature, 393, 537-544) makes it possible to determine the whole gene carrying the identified sequence according to the present invention.

Nucleotide sequence comprising the entire open reading frame of a sequence according to the invention is understood to mean the nucleotide sequence (genomic, cDNA, semi-synthetic or synthetic) comprising one of the sequences according to the invention and extending, on the one hand, in 5' of these sequences up to the first codon for initiation of translation (ATG or GTG) or even up to the first stop codon, and, on the other hand, in 3' of these sequences up to the next stop codon, this being in any one of the three possible reading frames.

The nucleotide sequences which are complementary to the above sequences according to the invention also form part of the invention.

Polynucleotide having a sequence which is complementary to a nucleotide sequence according to the invention is understood to mean any DNA or RNA sequence whose nucleotides are complementary to those of said sequence according to the invention and whose orientation is reversed.

The nucleotide fragments of the above sequences according to the invention, which are in particular useful as probes or primers, also form part of the invention.

The invention also relates to the polynucleotides, characterized in that they comprise a polynucleotide chosen from:

a) a polynucleotide whose sequence is complementary to the sequence of a polynucleotide according to the invention, b) a polynucleotide whose sequence comprises at least 50% identity with a polynucleotide according to the invention, c) a polynucleotide which hybridizes, under high stringency conditions, with a polynucleotide sequence according to the invention, d) a fragment of at least 8 consecutive nucleotides of a polynucleotide defined according to the invention.

The high stringency conditions as well as the percentage identity will be defined below in the present description.

When the coding sequence derived from the export and/or secretion marker gene is a sequence derived from the phoA gene, the export and/or secretion of the product of the phoA gene, truncated where appropriate, is obtained only when this sequence is inserted in phase with the sequence or element for regulating the expression of the production of polynucleotides and its location placed upstream, which contains the elements controlling the expression, export and/or secretion which are derived from a mycobacterial sequence.

The recombinant vectors of the invention may of course comprise multiple cloning sites which are shifted by one or two nucleotides relative to a vector according to the invention, thus making it possible to express the polypeptide corresponding to the mycobacterial DNA fragment which is inserted and which is capable of being translated according to one of the three possible reading frames.

For example, the preferred vectors pJVEDb and pJVEDc of the invention are distinguishable from the preferred vector pJVEDa by a respective shift of one and two nucleotides at the level of the multiple cloning site.

Thus, the vectors of the invention are capable of expressing each of the polypeptides which are capable of being encoded by an inserted mycobacterial DNA fragment. Said polypeptides, characterized in that they are therefore capable of being exported and/or secreted, and/or induced or repressed, or expressed constitutively during the infection, form part of the invention.

The polypeptides of the invention whose amino acid sequences are chosen from the amino acid sequences SEQ ID NOS 2-7, 9-13, 15-24, 26-30, 32, 34, 36-40, 42-45, 47-51, 53-55, 57-61, 63, 65-66, 68, 70-71, 73, 75, 77, 79-80, 82-83, 85, 87, 89, 91, 93-95, 97, 99, 101-103, 105, 107, 109, 111-112, 114-118, 120-121, 123-127, 129-132, 134-136, 138, 272-273, 140, 142, 144, 146-147, 149, 151, 153, 155, 157, 159, 161, 163-164, 166-168, 170-176, 178-183, 185-188, 190-194, 196-199, 201, 203-205, 207-208, 210, 212, 214-216, 218-219, 221-224, 226-227, 923-925, 229-237, 239-245, 247-249, 251-254, 256-257, 259, 261, 263-267, 269-271, 275-277, 279, 281, 283, 285, 287, 289, 291-296, 298-309, 311-316, 318-320, 322, 324, 326, 328-330, 332, 334, 336, 338, 340-345, 348-352, 354-356, 358, 360, 926-930, 362-363, 365-367, 369-370, 372-373, 375-379, 381-382, 384, 386, 388, 390-392, 394, 396, 398, 400-402, 404, 406, 408-409, 411, 413-418, 420, 422-425, 427-428, 430, 432, 434-436, 438-440, 442-446, 448-451, 453-455, 457-458, 460, 462, 464-468, 470-471, 473, 475, 477-481, 483-484, 486, 488, 490-494, 496, 498-500, 502-504, 506-509, 511-515, 517-518, 520-521, 523-527, 531-533, 535-536, 538-542, 543, 545, 547-549, 551, 553, 555, 557, 559-563, 565-568, 570, 572, 574-575, 577-579, 581-583, 585, 587, 589, 591-593, 595, 597, 599, 601-603, 605-607, 609, 611, 613, 615, 617, 619, 621, 623, 625, 627-628, 630, 632, 634, 636-639, 641-646, 648, 650, 652, 654-656, 658-659, 661, 663, 665, 931-933, 667-668, 670-673, 675, 677, 679-682, 684-685, 687-690, 692, 694, 696, 698-701, 703-716, 718-727, 729-732, 734-735, 737-738, 740, 742, 744-745, 747-751, 753-754, 756, 758, 760, 762-763, 765-766, 768, 770, 772-783, 785-793, 795-804, 806, 808, 810, 812, 814-816, 818-820, 822, 824, 826, 828-830, 832, 834, 836, 838, 840-841, 843, 845, 847, 849-863, 865-877, 879-882, 884, 886, 888-894, 896-900, 902-906, 908, 910, and represented respectively by FIGS. 1 to 24C (plates 1 to 150), FIGS. 27A to 28 (plates 152 to 155) and FIGS. 30 to 50F (plates 157 to 275) are in particular preferred.

Also forming part of the invention are the fragments or biologically active fragments as well as the polypeptides which are homologous to said polypeptides; fragment, biologically active fragment and polypeptides which are homologous to a polypeptide being as defined below in the description.

The invention also relates to the polypeptides comprising a polypeptide or one of their fragments according to the invention.

The subject of the invention is also recombinant mycobacteria containing a recombinant vector according to the invention which is described above. A preferred *mycobacterium* is a *mycobacterium* of the *M. smegmatis* type.

*M. smegmatis* advantageously makes it possible to test the efficiency of mycobacterial sequences for controlling the expression, export and/or secretion, and/or promoter activity of a given sequence, for example of a sequence encoding a marker such as alkaline phosphatase and/or luciferase.

Another preferred *mycobacterium* is a *mycobacterium* of the *M. bovis* type, for example the BCG strain which is currently used for vaccination against tuberculosis.

Another preferred *mycobacterium* is a strain of *M. tuberculosis*, *M. bovis* or *M. africanum* potentially possessing all the appropriate regulatory systems.

The inventors have thus characterized, in particular, a polynucleotide consisting of a nucleotide sequence which is present in all the tested strains of mycobacteria belonging to the *Mycobacterium tuberculosis* complex. This polynucleotide, called DP428, contains an open reading frame (ORF) encoding a polypeptide of about 12 kD. The open reading frame (ORF) encoding the polypeptide DP428 extends from the nucleotide at position nt 451 to the nucleotide at position nt 861 of the sequence SEQ ID NO: 35, the polypeptide DP428 having the following amino acid sequences SEQ ID NOS: 39 & 543: MKTGTATTRRRLLAVLIALALP-GAAVALLAEPSATGASDPCAASEEVARTVGSVA KSMGDYLDSHPETNQVMTAVLQQQVG-PGSVASLKAHFEANPKVASDLHALSQ PLTDLSTRCS-LPISGLQAIGLMQAVQGARR.

This molecular weight (MW) corresponds to the theoretical MW of the mature protein obtained after cleavage of the signal sequence, the MW of the protein or polypeptide DP428 being about 10 kD after potential anchorage to peptidoglycan and potential cleavage between S and G of the LPISG motif.

This polynucleotide includes, on the one hand, an open reading frame corresponding to a structural gene and, on the other hand, the signals for regulating the expression of the coding sequence upstream and downstream of the latter. The polypeptide DP428 is composed of a signal peptide, a hydrophilic central region and a hydrophobic C-terminal region. The latter ends with two arginine residues (R), a retention signal, and is preceded by an LPISG motif which resembles the LPXTG motif for anchorage to peptidoglycan (Schneewind et al., 1995).

Structural gene for the purposes of the present invention is understood to mean a polynucleotide encoding a protein, a polypeptide or alternatively a fragment of the latter, said polynucleotide comprising only the sequence corresponding to the open reading frame (ORF), which excludes the sequences on the 5' side of the open reading frame (ORF) which direct the initiation of transcription.

Thus, the invention relates in particular to a polynucleotide whose sequence is chosen from the nucleotide sequences SEQ ID NOS: 1, 8, 14, 25, 31, 33, and 35.

More particularly, the invention relates to a polynucleotide, characterized in that it comprises a polynucleotide chosen from:

a) a polynucleotide whose sequence is chosen from the nucleotide sequences SEQ ID NOS: 1, 8, 14, 25, 31, 33, and 35, b) a polynucleotide whose nucleic sequence is the sequence between the nucleotide at position nt 964 and the nucleotide at position nt 1234, ends included, of the sequence SEQ ID NOS: 1, 8, 14, 25, 31, and 33, c) a polynucleotide whose sequence is complementary to the sequence of a polynucleotide defined in a) or b), d) a polynucleotide whose sequence exhibits at least 50% identity with a polynucleotide defined in a), b) or c), e) a polynucleotide which hybridizes, under high stringency conditions, with a sequence of a polynucleotide defined in a), b), c) or d), f) a fragment of at least 8 consecutive nucleotides of a polynucleotide defined in a), b), c), d) or e).

Nucleotide sequence, polynucleotide or nucleic acid is understood to mean, according to the present invention, a double-stranded DNA, a single-stranded DNA and products of transcription of said DNAs.

Percentage identity for the purpose of the present invention is understood to mean a percentage identity between the bases of two polynucleotides, this percentage being purely statistical and the differences between the two polynucleotides being distributed randomly and over their entire length.

Hybridization under high stringency conditions means that the temperature and ionic strength conditions are chosen such that they allow the hybridization between two complementary DNA fragments to be maintained.

By way of illustration, high stringency conditions of the hybridization step for the purposes of defining the polynucleotide fragments described above are advantageously the following:

the hybridization is carried out at a temperature which is preferably 65° C., in the presence of buffer marketed under the name rapid-hyb buffer by Amersham (RPN 1636) and 100 µg/ml of *E. coli* DNA.

The washing steps may, for example, be the following:

two washes of 10 min, preferably at 65° C., in a 2×SSC buffer and 0.1% SDS;

two washes of 10 min, preferably at 65° C., in a 1×SSC buffer and 0.1% SDS;

one wash of 10 min, preferably at 65° C., in a 0.1×SSC buffer and 0.1% SDS.

1×SSC corresponds to 0.15 M NaCl and 0.05 M Na citrate and a 1× Denhardt solution corresponds to 0.02% Ficoll, 0.02% of polyvinylpyrrolidone and 0.02% of bovine serum albumin.

Advantageously, a nucleotide fragment corresponding to the preceding definition will have at least 8 nucleotides, preferably at least 12 nucleotides, and still more preferably at least 20 consecutive nucleotides of the sequence from which it is derived. The high stringency hybridization conditions described above for a polynucleotide having a size of about 200 bases will be adjusted by persons skilled in the art for oligonucleotides with a larger or a smaller size, according to the teaching of Sambrook et al., 1989.

For the conditions for using the restriction enzymes with the aim of obtaining nucleotide fragments of the polynucleotides according to the invention, reference will be advantageously made to the manual by Sambrook et al., 1989.

Advantageously, a polynucleotide of the invention will contain at least one sequence comprising the stretch of nucleotides going from the nucleotide at position nt 964 to the nucleotide nt 1234 of the polynucleotide having the sequence SEQ ID NOS 1, 8, 14, 25, 31, and 33.

The subject of the present invention is a polynucleotide according to the invention, characterized in that its nucleic sequence hybridizes with the DNA of a sequence of mycobacteria and preferably with the DNA of a sequence of mycobacteria belonging to the *Mycobacterium tuberculosis* complex.

The polynucleotide is encoded by a polynucleotide sequence as described supra.

The subject of the present invention is also a polypeptide derived from a *mycobacterium*, characterized in that it is present only in the mycobacteria belonging to the *Mycobacterium tuberculosis* complex.

The invention also relates to a polypeptide characterized in that it comprises a polypeptide chosen from:

a) a polypeptide whose amino acid sequence is included in an amino acid sequence chosen from the amino acid sequences SEQ ID NOS 2-7, 9-13, 15-24, 26-30, 32, 34, 36-40, 42-45, 47-51, 53-55, 57-61, 63, 65-66, 68, 70-71, 73, 75, 77, 79-80, 82-83, 85, 87, 89, 91, 93-95, 97, 99, 101-103, 105, 107, 109, 111-112, 114-118, 120-121, 123-127, 129-132, 134-136, 138, 272-273, 140, 142, 144, 146-147, 149, 151, 153, 155, 157, 159, 161, 163-164, 166-168, 170-176, 178-183, 185-188, 190-194, 196-199, 201, 203-205, 207-208, 210, 212, 214-216, 218-219, 221-224, 226-227, 923-925, 229-237, 239-245, 247-249, 251-254, 256-257, 259, 261, 263-267, 269-271, 275-277, 279, 281, 283, 285, 287, 289, 291-296, 298-309, 311-316, 318-320, 322, 324, 326, 328-330, 332, 334, 336, 338, 340-345, 348-352, 354-356, 358, 360, 926-930, 362-363, 365-367, 369-370, 372-373, 375-379, 381-382, 384, 386, 388, 390-392, 394, 396, 398, 400-402, 404, 406, 408-409, 411, 413-418, 420, 422-425, 427-428, 430, 432, 434-436, 438-440, 442-446, 448-451, 453-455, 457-458, 460, 462, 464-468, 470-471, 473, 475, 477-481, 483-484, 486, 488, 490-494, 496, 498-500, 502-504, 506-509, 511-5.15, 517-518, 520-521, 523-527, 531-533, 535-536, 538-542, 543, 545, 547-549, 551, 553, 555, 557, 559-563, 565-568, 570, 572, 574-575, 577-579, 581-583, 585, 587, 589, 591-593, 595, 597, 599, 601-603, 605-607, 609, 611, 613, 615, 617, 619, 621, 623, 625, 627-628, 630, 632, 634, 636-639, 641-646, 648, 650, 652, 654-656, 658-659, 661, 663, 665, 931-933, 667-668, 670-673, 675, 677, 679-682, 684-685, 687-690, 692, 694, 696, 698-701, 703-716, 718-727, 729-732, 734-735, 737-738, 740, 742, 744-745, 747-751, 753-754, 756, 758, 760, 762-763, 765-766, 768, 770, 772-783, 785-793, 795-804, 806, 808, 810, 812, 814-816, 818-820, 822, 824, 826, 828-830, 832, 834, 836, 838, 840-841, 843, 845, 847, 849-863, 865-877, 879-882, 884, 886, 888-894, 896-900, 902-906, 908, and 910 b) a polypeptide which is homologous to the polypeptide defined in a), c) a fragment of at least 5 amino acids of a polypeptide defined in a) or b), d) a biologically active fragment of a polypeptide defined in a), b) or c).

The subject of the present invention is also a polypeptide whose amino acid sequence is included in the amino acid sequences SEQ ID NOS: SEQ ID NOS: 2-7, 9-13, 15-24, 26-30, 32, 34, 36-40, or a polypeptide having the amino acid sequence SEQ ID NO: 543.

Homologous polypeptide will be understood to designate the polypeptides exhibiting, relative to the natural polypeptide according to the invention such as the polypeptide DP428, certain modifications such as in particular a deletion, addition or substitution of at least one amino acid, a truncation, an extension, a chimeric fusion, and/or a mutation. Among the homologous polypeptides, those whose amino acid sequence exhibits at least 30%, preferably 50%, homology with the amino acid sequences of the polypeptides according to the invention are preferred. In the case of a substitution, one or more consecutive or nonconsecutive amino acids are replaced with "equivalent" amino acids. The expression "equivalent" amino acid is intended here to designate any amino acid capable of being substituted for one of the amino acids of the parent structure without, however, essentially modifying the immunogenic properties of the corresponding peptides. In other words, the equivalent amino acids will be those which allow the production of a polypeptide having a modified sequence which allows the induction in vivo of antibodies or of cells capable of recognizing the polypeptide whose amino acid sequence is included in the amino acid sequence of the polypeptide according to the invention, such as the amino acid sequences SEQ ID NOS: 2-7, 9-13, 15-24, 26-30, 32, 34, 36-40, or a polypeptide having the amino acid sequence SEQ ID NO: 543 (polypeptide DP428) or one of its above-defined fragments.

These equivalent aminoacyls may be determined either based on their structural homology with the aminoacyls for which they are substituted, or on the results of cross-immunogenicity assays to which the different peptides are capable of giving rise.

By way of example, there may be mentioned the possibilities of substitutions which are capable of being made without resulting in a profound modification of the immunogenicity of the corresponding modified peptides, the replacements, for example, of leucine with valine or isoleucine, of aspartic acid with glutamic acid, of glutamine with asparagine and of arginine with lysine, and the like, it being possible to naturally envisage the reverse substitutions under the same conditions.

Biologically active fragment will be understood to designate in particular a fragment of an amino acid sequence of a polypeptide having at least one of the characteristics of the polypeptides according to the invention, in particular in that it is:

capable of being exported and/or secreted by a *mycobacterium*, and/or of being induced or repressed during infection with the *mycobacterium*; and/or capable of inducing, repressing or modulating, directly or indirectly, a *mycobacterium* virulence factor; and/or capable of inducing an immunogenicity reaction directed against mycobacteria; and/or capable of being recognized by an antibody which is specific for *mycobacterium*.

Polypeptide fragment is understood to designate a polypeptide comprising a minimum of 5 amino acids, preferably 10 amino acids and 15 amino acids.

A polypeptide of the invention, or one of its fragments, as defined above, is capable of being specifically recognized by the antibodies present in the serum of patients infected by mycobacteria and preferably bacteria belonging to the *Mycobacterium tuberculosis* complex or by cells of the infected host.

Thus, forming part of the invention are the fragments of the polypeptide whose amino acid sequence is included in the amino acid sequence of a polypeptide according to the invention, such as the amino acid sequences SEQ ID NOS: 2-7, 9-13, 15-24, 26-30, 32, 34, 36-40, or a polypeptide having an amino acid sequence SEQ ID NO: 543, which may be obtained by cleavage of said polypeptide with a proteolytic enzyme, such as trypsin or chymotrypsin or collagenase, or with a chemical reagent, such as cyanogen bromide (CNBr) or alternatively by placing a polypeptide according to the invention such as the polypeptide DP428 in a very acidic environment, for example at pH 2.5. Preferred peptide fragments according to the invention, for use in diagnosis or in vaccination, are the fragments contained in regions of a polypeptide according to the invention such as the polypeptide DP428 which are capable of being naturally exposed to the solvent and to thus exhibit substantial immunogenicity properties. Such peptide fragments may be prepared either by chemical synthesis, from hosts transformed with an expression vector according to the invention containing a nucleic acid allowing the expression of said fragments, placed under the control of appropriate regulatory and/or expression elements or alternatively by chemical or enzymatic cleavage.

Analysis of the hydrophilicity of the polypeptide DP428 was carried out with the aid of the DNA Strider™ software (marketed by CEA Saclay) on the basis of a calculation of the hydrophilic character of the region encoding DP428 of SEQ ID NO: 543. The results of this analysis are presented in FIG. 54 where the hydrophilicity index is detailed, for each of the amino acids (AA) having a defined position in SEQ ID NO: 543. The higher the hydrophilicity index, the more the amino acid considered is likely to be exposed to the solvent in the native molecule, and is subsequently likely to exhibit a high degree of antigenicity. Thus, a stretch of at least seven amino acids possessing a high hydrophilicity index (>0.3) can constitute the basis of the structure of an immunogenic candidate peptide according to the present invention.

The cellular immune responses of the host to a polypeptide according to the invention can be demonstrated according to the techniques described by Colignon et al., 1996.

Figure 54:
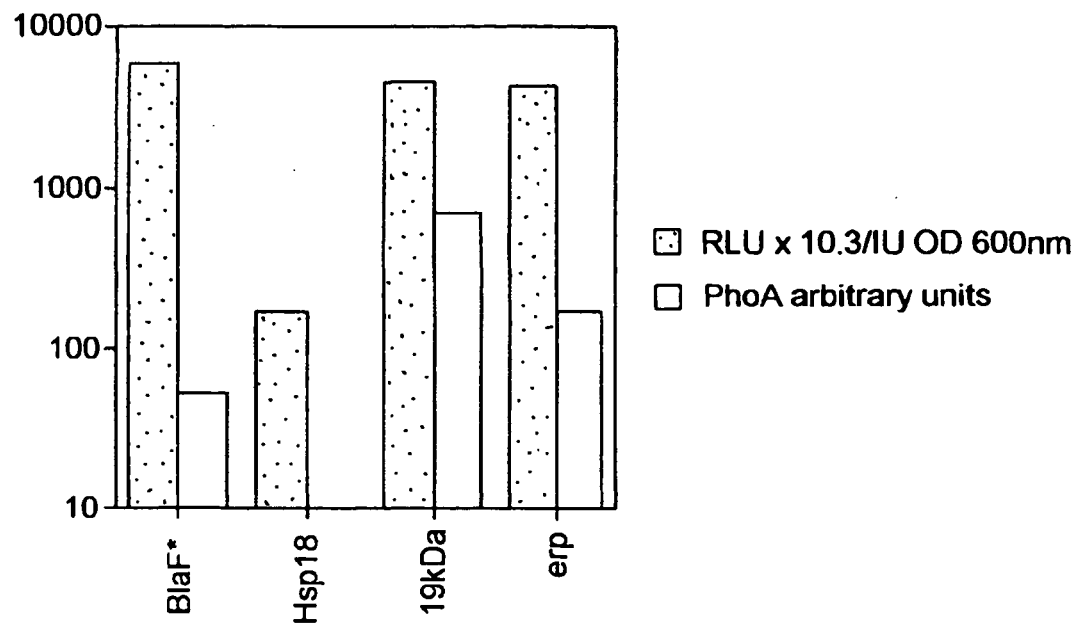
Figure 55:
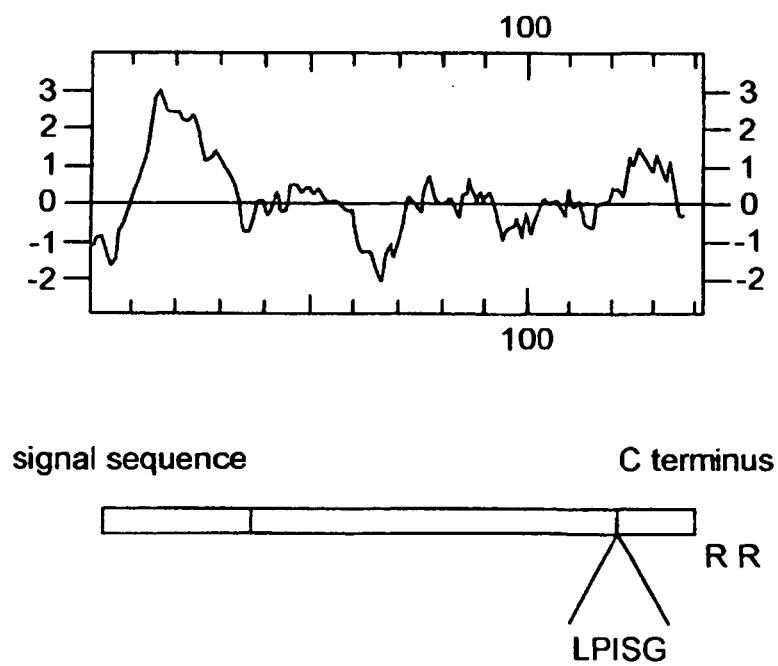

From the data of the hydrophilicity map presented in FIG. 54, the inventors were able to define regions of the polypeptide DP428 which are preferably exposed to the solvent, more particularly the region located between amino acids 55 and 72 of the sequence SEQ ID NO: 543 and the region located between amino acids 99 and 107 of SEQ ID NO: 543.

The peptide regions of the polypeptide DP428 which are defined above may be advantageously used for the production of immunogenic compositions or of vaccine compositions according to the invention.

The polynucleotides characterized in that they encode a polypeptide according to the invention also form part of the invention.

The invention also relates to the nucleic acid sequences which can be used as probes or primers, characterized in that said sequences are chosen from the nucleic acid sequences of polynucleotides according to the invention.

The invention relates, in addition, to the use of a nucleic acid sequence of polynucleotides according to the invention as a probe or a primer for the detection and/or amplification of a nucleic acid sequence. Among these nucleic acid sequences according to the invention which can be used as probes or primers there are preferred the nucleic acid sequences of the invention, characterized in that said sequences are sequences, or their complementary sequence, between the nucleotide at position nt 964 and the nucleotide at position nt 1234, ends included, of the sequence SEQ ID NOS: 1, 8, 14, 25, 31, and 33.

Among the polynucleotides according to the invention which can be used as nucleotide primers, the polynucleotides having the sequences SEQ ID NO: 528 and SEQ ID NO: 529 are particularly preferred.

The polynucleotides according to the invention may thus be used to select nucleotide primers, in particular for the PCR technique (Erlich, 1989; Innis et al., 1990, and, Rolfs et al., 1991).

This technique requires the choice of oligonucleotide pairs flanking the fragment which has to be amplified. Reference may be made, for example, to the technique described in American patent U.S. Pat. No. 4,683,202. These oligodeoxyribonucleotide or oligoribonucleotide primers advantageously have a length of at least 8 nucleotides, preferably of at least 12 nucleotides, and still more preferably of at least 20 nucleotides. Primers having a length of between 8 and 30 and preferably 12 and 22 nucleotides will be preferred in particular. One of the two primers is complementary to the (+) strand [forward primer] of the template and the other primer is complementary to the (−) strand [backward primer]. It is important that the primers do not possess a secondary structure or sequences which are complementary to each other. Moreover, the length and the sequence of each primer should be chosen so that the primers do not hybridize with other nucleic acids from prokaryotic or eukaryotic cells, in particular with the nucleic acids from other pathogenic mycobacteria, or with human DNA or RNA which may possibly contaminate the biological sample.

Figure 51:
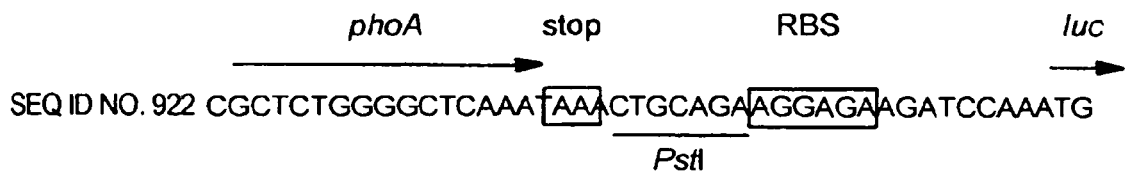

The results presented in FIG. 51 show that the sequence encoding the polypeptide DP428 (SEQ ID NO: 543) is not found in the DNAs of *M. foatuitum*, *M. simiae*, *M. avium*, *M. chelonae*, *M. flavescens*, *M. gordonae*, *M. marinum* and *M. kansasii*.

The amplified fragments may be identified after agarose or polyacrylamide gel electrophoresis or after capillary electrophoresis, or alternatively after a chromatographic technique (gel filtration, hydrophobic chromatography or ion-exchange chromatography). The specificity of the amplification may be checked by molecular hybridization using, as probes, the nucleotide sequences of polynucleotides of the invention, plasmids containing these sequences or their amplification products.

The amplified nucleotide fragments may be used as reagents in hybridization reactions in order to detect the presence, in a biological sample, of a target nucleic acid having a sequence which is complementary to that of said amplified nucleotide fragments.

Among the polynucleotides according to the invention which can be used as nucleotide probes, the polynucleotide fragment comprising the sequence between the nucleotide at position nt 964 and the nucleotide at position nt 1234, ends included, of the sequence SEQ ID NO: 1 is most particularly preferred.

These probes and amplicons may be labeled or otherwise with radioactive elements or with nonradioactive molecules such as enzymes or fluorescent elements.

The invention also relates to the nucleotide fragments which are capable of being obtained by amplification with the aid of primers according to the invention.

Other techniques for the amplification of the target nucleic acid may be advantageously used as alternatives to PCR.

The SDA (Strand Displacement Amplification) technique (Walker et al., 1992) is an isothermic amplification technique whose principle is based on the capacity of a restriction enzyme to cut one of the two strands of its recognition site which is in the form of a hemiphosphorothioate and on the property of a DNA polymerase to initiate the synthesis of a new DNA strand from the 3'OH end created by the restriction enzyme and to displace the strand previously synthesized which is present downstream.

The polynucleotides of the invention, in particular the primers according to the invention, may also be used in other methods of amplifying a target nucleic acid, such as:

the TAS (Transcription-based Amplification System) technique described by Kwoh et al. in 1989;

the 3SR (Self-Sustained Sequence Replication) technique described by Guatelli et al. in 1990;

the NASBA (Nucleic Acid Sequence Based Amplification) technique described by Kievitis et al. in 1991;

the TMA (Transcription Mediated Amplification) technique.

The polynucleotides of the invention may also be used in techniques for the amplification or modification of the nucleic acid serving as probe, such as:

the LCR (Ligase Chain Reaction) technique described by Landegren et al. in 1988 and improved by Barany et al. in 1991, which uses a heat-stable ligase;

the RCR (Repair Chain Reaction) technique described by Segev in 1992;

the CPR (Cycling Probe Reaction) technique described by Duck et al. in 1990;

the Q-beta-replicase amplification technique described by Miele et al. in 1983 and improved in particular by Chu et al. in 1986, Lizardi et al. in 1988 and then by Burg et al. as well as Stone et al. in 1996.

In the case where the target polynucleotide to be detected is an RNA, for example an mRNA, a reverse transcriptase-type enzyme will be advantageously used, prior to using an amplification reaction using the primers according to the invention or to the use of a method of detection using the probes of the invention, in order to obtain a cDNA from the RNA contained in the biological sample. The cDNA obtained will then serve as target for the primers or probes used in the method of amplification or detection according to the invention.

The detection probe will be chosen so that it hybridizes with the amplicon generated. Such a detection probe will advantageously have a sequence of at least 12 nucleotides in particular of at least 15 nucleotides and preferably at least 200 nucleotides.

The nucleotide probes according to the invention are capable of detecting mycobacteria and preferably bacteria belonging to the *Mycobacterium tuberculosis* complex, more particularly because of the fact that these mycobacteria possess in their genome at least one copy of polynucleotides according to the invention. These probes according to the invention are capable, for example, of hybridizing with the nucleotide sequence of a polypeptide according to the invention, more particularly any oligonucleotide hybridizing with the sequences SEQ ID NOS 1, 8, 14, 25, 31, and 33 encoding the *M. tuberculosis* polypeptide DP428 and not exhibiting a cross-hybridization reaction or an amplification reaction (PCR) with, for example, sequences present in mycobacteria not belonging to the *Mycobacterium tuberculosis* complex. The nucleotide probes according to the invention hybridize specifically with a DNA or RNA molecule of a polynucleotide according to the invention, under high stringency hybridization conditions as given in the form of an example above.

The nonlabeled sequences may be used directly as probes. However, the sequences are generally labeled with a radioactive element ($^{32}P$, $^{35}S$, $^{3}H$, $^{125}I$) or with a nonradioactive molecule (biotin, acetylaminofluorene, digoxigenin, 5-bromodeoxyuridine, fluorescein) in order to obtain probes which can be used for many applications.

Examples of nonradioactive labelings of probes are described, for example, in French patent No. 78,10975 or by Urdea et al. or by Sanchez-Pescador et al. in 1988.

In the latter case, it will also be possible to use one of the labeling methods described in patents FR 2,422,956 and FR 2,518,755. The hybridization technique may be carried out in various ways (Matthews et al., 1988). The most common method consists in immobilizing the nucleic acid extracted from mycobacterial cells onto a support (such as nitrocellulose, nylon, polystyrene) and in incubating, under well-defined conditions, the immobilized target nucleic acid with the probe. After hybridization, the excess probe is removed and the hybrid molecules formed are detected by the appropriate method (measurement of the radioactivity, of the fluorescence or of the enzymatic activity linked to the probe).

Advantageously, the labeled nucleotide probes according to the invention may have a structure such that they make amplification of the radioactive or nonradioactive signal possible. An amplification system corresponding to the above definition will comprise detection probes in the form of a branched, ramified DNA such as those described by Urdea et al. in 1991. According to this technique, several types of probe, in particular a capture probe, to immobilize the target DNA or RNA to a support, and a detection probe will be advantageously used. The detection probe binds a "branched" DNA having a ramified structure. The branched DNA in turn is capable of binding oligonucleotide probes which are themselves coupled to alkaline phosphatase molecules. The activity of this enzyme is then detected using a chemiluminescent substrate, for example a derivative of dioxethane phosphate.

According to another advantageous embodiment of the nucleic probes according to the invention, they can be covalently or noncovalently immobilized on a support and used as capture probes. In this case, a probe termed "capture probe" is immobilized on a support and serves to capture, through specific hybridization, the target nucleic acid obtained from the biological sample to be tested. If necessary, the solid support is separated from the sample and the duplex formed between the capture probe and the target nucleic acid is then detected by means of a second probe termed "detection probe" which is labeled with an easily detectable element.

The oligonucleotide fragments may be obtained from the sequences according to the invention by cleavage with restriction enzymes or by chemical synthesis according to conventional methods, for example according to the method described in European patent No. EP-0,305,929 (Millipore Corporation) or by other methods.

An appropriate method of preparing the nucleic acids of the invention comprising a maximum of 200 nucleotides (or 200 bp in the case of double-stranded nucleic acids) comprises the following steps:

synthesis of DNA using the automated beta-cyanethylphosphoramidite method described in 1986, cloning of the nucleic acids thus obtained into an appropriate vector and recovery of the nucleic acids by hybridization with an appropriate probe.

A method of preparation, by the chemical route, of nucleic acids according to the invention having a length greater than 200 nucleotides (or 200 bp in the case of double-stranded nucleic acids) comprises the following steps:

assembly of chemically synthesized oligonucleotides, provided at their end with different restriction sites, whose sequences are compatible with the stretch of amino acids of the natural polypeptide according to the principle described in 1983, cloning of the nucleic acids thus obtained into an appropriate vector and recovery of the desired nucleic acids by hybridization with an appropriate probe.

The nucleotide probes used for recovering the desired nucleic acids in the abovementioned methods generally consist of 8 to 200 nucleotides of the polypeptide sequence according to the invention and are capable of hybridizing with the nucleic acid tested for under the hybridization conditions defined above. The synthesis of these probes may be carried out according to the automated beta-cyanethylphosphoramidite method described in 1986.

The oligonucleotide probes according to the invention may be used in a detection device comprising an oligonucleotide array library. An exemplary embodiment of such an array library may consist of an array of probe oligonucleotides which are attached to a support, the sequence of each probe of a given length being situated with a shift of one or more bases relative to the preceding probe, each of the probes of the array arrangement thus being complementary to a distinct sequence of the target DNA or RNA to be detected and each probe of known sequence being attached at a predetermined position of the support. The target sequence to be detected may be advantageously labeled radioactively or nonradioactively. When the labeled target sequence is brought into contact with the array device, it forms hybrids with the probes having complementary sequences. A nuclease treatment, followed by washing, makes it possible to remove the probe-target sequence hybrids which are not perfectly complementary. Because of the precise knowledge of the sequence of a probe at a given position of the array, it is then possible to deduce the nucleotide sequence of the target DNA or RNA sequence. This technique is particularly effective when matrices of oligonucleotide probes of a large size are used.

An alternative to the use of a labeled target sequence may consist of using a support allowing a "bioelectronic" detection of the hybridization of the target sequence with the probes of the array support, when said support consists of or comprises a material capable of acting, for example, as an electron donor at the positions of the array where a hybrid has been formed. Such an electron-donating material is for example gold. The detection of the nucleotide sequence of the target DNA or RNA is then determined by an electronic device.

An exemplary embodiment of a biosensor, as defined above, is described in European patent application No. EP-0,721,016 in the name of Affymax Technologies N.V. or in American patent No. U.S. Pat. No. 5,202,231 in the name of Drmanac.

The subject of the invention is also the hybrid polynucleotides resulting:

either from the formation of a hybrid molecule between an RNA or a DNA (genomic DNA or cDNA) obtained from a biological sample with a probe or a primer according to the invention, or from the formation of a hybrid molecule between an RNA or a DNA (genomic DNA or cDNA) obtained from a biological sample with a nucleotide fragment amplified with the aid of a pair of primers according to the invention.

cDNA for the purposes of the invention is understood to mean a DNA molecule obtained by causing a reverse transcriptase type enzyme to act on an RNA molecule, in particular a messenger RNA (mRNA) molecule, according to the techniques described in Sambrook et al. in 1989.

The subject of the present invention is also a family of recombinant plasmids, characterized in that they contain at least one nucleotide sequence of a polynucleotide according to the invention. According to an advantageous embodiment of said plasmid it comprises the nucleotide sequences SEQ ID NOS: 1, 8, 14, 25, 31, and 33, or a fragment thereof.

Another subject of the present invention is a vector for the cloning, expression and/or insertion of a sequence, characterized in that it comprises a nucleotide sequence of a polynucleotide according to the invention at a site which is not essential for its replication, where appropriate under the control of regulatory elements capable of playing a role in the expression of the polypeptide DP428, in a given host.

Specific vectors are for example plasmids, phages, cosmids, phagemids and YACs.

These vectors are useful for transforming host cells so as to clone or express the nucleotide sequences of the invention.

The invention also comprises the host cells transformed with a vector according to the invention.

Preferably, the host cells are transformed under conditions allowing the expression of a recombinant polypeptide according to the invention.

A preferred host cells according to the invention is the *E. coli* strain transformed with the plasmid pDP428 deposited on 28 Jan. 1997 at the CNCM under the No. I-1818 or transformed with the plasmid pM1C25 which was deposited on 4 Aug. 1998 at the CNCM under the No. I-2062 or a *mycobacterium* belonging to a strain of *M. tuberculosis, M. bovis* or *M. africanum* potentially possessing all the appropriate regulatory systems.

It is now easy to produce proteins or polypeptides in a relatively large quantity by genetic engineering using, as expression vectors, plasmids, phages or phagemids. All or part of the DP428 gene, or any polynucleotide according to the invention, may be inserted into an appropriate expression vector in order to produce in vitro a polypeptide according to the invention, in particular the polypeptide DP428. Said polypeptide may be attached to a microplate in order to develop a serological test intended to search, for diagnostic purposes, for the specific antibodies in patients suffering tuberculosis.

Thus, the present invention relates to a method of preparing a polypeptide, characterized in that it uses a vector according to the invention. More particularly, the invention relates to a method of preparing a polypeptide of the invention comprising the following steps:

where appropriate, the prior amplification, according to the PCR technique, of the quantity of nucleotide sequences encoding said polypeptide with the aid of two DNA primers chosen so that one of these primers is identical to the first 10 to 25 nucleotides of the nucleotide sequence encoding said polypeptide, while the other primer is complementary to the last 10 to 25 nucleotides (or hybridizes with these last 10 to 25 nucleotides) of said nucleotide sequence, or conversely so that one of these primers is identical to the last 10 to 25 nucleotides of said sequence, while the other primer is complementary to the first 10 to 25 nucleotides (or hybridizes with the first 10 to 25 nucleotides) of said nucleotide sequence, followed by the introductic said sequences thus amplified into an appropriate vector, the culture, in an appropriate culture medium, of a cellular host which has been previously transformed with an appropriate vector containing a nucleic acid according to the invention comprising the nucleotide sequence encoding said polypeptide, and the separation, from said culture medium, of said polypeptide produced by said transformed cellular host.

The subject of the invention is also a polypeptide which is capable of being obtained by a method of the invention as described above.

The peptides according to the invention may also be prepared by techniques which are conventionally used in the field of peptide synthesis. This synthesis may be carried out in homogeneous solution or in solid phase.

For example, the technique of synthesis in homogeneous solution described by Houbenweyl in 1974 will be used.

This method of synthesis consists in successively condensing in pairs the successive aminoacyls in the required order, or in condensing aminoacyls and fragments formed beforehand and already containing several aminoacyls in the appropriate order, or alternatively several fragments thus prepared beforehand, it being understood that care will be taken to protect beforehand all the reactive functions carried by these aminoacyls or fragments, with the exception of the amine functions of one and the carboxyl functions of the other or vice versa, which should normally be involved in the formation of the peptide bonds, in particular after activation of the carboxyl function, according to methods well known in peptide synthesis. As a variant, use may be made of coupling reactions using conventional coupling reagents, of the carbodiimide type, such as for example 1-ethyl-3-(3-dimethylaminopropyl)carbodiimide.

When the aminoacyl used possesses an additional acid function (in particular in the case of glutamic acid), these functions will be protected, for example with t-butyl ester groups.

In the case of gradual synthesis, amino acid by amino acid, the synthesis preferably starts with the condensation of the C-terminal amino acid with the amino acid which corresponds to the neighboring aminoacyl in the desired sequence, and so on, step by step, up to the N-terminal amino acid.

According to another preferred technique of the invention, the one described by Merrifield is used.

To manufacture a peptide chain according to the Merrifield method, use is made of a very porous polymer resin onto which the first C-terminal amino acid of the chain is attached. This amino acid is attached to the resin via its carboxyl group and its amine function is protected, for example with the t-butyloxycarbonyl group.

When the first C-terminal amino acid is thus attached to the resin, the group for protecting the amine function is removed by washing the resin with an acid.

In the case where the group for protecting the amine function is the t-butyloxycarbonyl group, it may be removed by treating the resin with trifluoroacetic acid.

The second amino acid which provides the second aminoacyl of the desired sequence, from the C-terminal aminoacyl residue, is then coupled with the deprotected amine function of the first C-terminal amino acid attached to the chain. Preferably, the carboxyl function of this second amino acid is activated, for example with dicyclohexylcarbodiimide, and the amine function is protected, for example with t-butyloxycarbonyl.

The first portion of the desired peptide chain is thus obtained which comprises two amino acids, and whose terminal amine function is protected. As before, the amine function is deprotected and it is then possible to proceed to the attachment of the third aminoacyl, under conditions similar to those for the addition of the second C-terminal amino acid.

The amino acids which will constitute the peptide chain will thus be attached, one after the other, to the amino group, each time deprotected beforehand, of the portion of the peptide chain which is already formed and which is attached to the resin.

When the entire desired peptide chain is formed, the groups for protecting the different amino acids constituting the peptide chain are removed and the peptide is detached from the resin, for example with the aid of hydrofluoric acid.

Preferably, said polypeptides which are capable of being obtained by a method of the invention as described above will comprise a region exposed to the solvent and will have a length of at least 20 amino acids.

According to another embodiment of the invention, said polypeptides are specific to mycobacteria of the *Mycobacterium tuberculosis* complex and are not therefore recognized by antibodies specific for other mycobacterial proteins.

The invention relates, in addition, to hybrid polypeptides having at least one polypeptide according to the invention and a sequence of a polypeptide capable of inducing an immune response in humans or animals.

Advantageously, the antigenic determinant is such that it is capable of inducing a humoral and/or cellular response.

Such a determinant may comprise a polypeptide according to the invention, in glycosylated form, which is used to obtain immunogenic compositions capable of inducing the synthesis of antibodies directed against multiple epitopes. Said glycosylated polypeptides also form part of the invention.

These hybrid molecules may consist in part of a polypeptide-carrying molecule according to the invention combined with a portion, in particular an epitope of the diphtheria toxin, the tetanus toxin, a hepatitis B virus surface antigen (patent FR 79 21811), the VP1 antigen of the poliomyelitis virus or any other viral or bacterial toxin or antigen.

Advantageously, said antigenic determinant corresponds to an antigenic determinant of immunogenic proteins of 45/47 kD of *M. tuberculosis* (international application PCT/FR 96/0166), or alternatively which are selected for example from ESAT6 (Harboe et al., 1996, Andersen et al., 1995, and Sorensen et al., 1995) and DES (PCT/FR 97/00923, Gicquel et al.).

A viral antigen, as defined above, will be preferably a hepatitis virus surface or envelope protein, for example the hepatitis B surface protein in one of its S,S-preS1, S-preS2 or S-preS2-preS1 forms or alternatively a protein of a hepatitis A virus, or of a hepatitis non-A, non-B virus, such as a hepatitis C, E or delta virus.

More particularly, a viral antigen as defined above will be the whole or part of one of the glycoproteins encoded by the genome of the HIV-1 virus (patents GB 8324800, EP 84401834 or EP 85905513) or of the HIV-2 virus (EP 87400151), and in particular the whole or part of a protein selected from gag, pol, nef or env of HIV-1 or HIV-2.

The methods for synthesizing the hybrid molecules include the methods used in genetic engineering to construct hybrid polynucleotides encoding the desired polypeptide sequences. Reference may be advantageously made, for example, to the technique for the production of genes encoding fusion proteins described by Minton in 1984.

Said hybrid polynucleotides encoding a hybrid polypeptide as well as the hybrid polypeptides according to the invention characterized in that they are recombinant proteins obtained by the expression of said hybrid polynucleotides also form part of the invention.

The polypeptides according to the invention may advantageously be used in a method for the in vitro detection of antibodies directed against said polypeptides, in particular the polypeptide DP428, and also of antibodies directed against a bacterium of the *Mycobacterium tuberculosis* complex, in a biological sample (biological tissue or fluid) capable of containing them, this method comprising bringing this biological sample into contact with a polypeptide according to the invention under conditions allowing an immunological reaction in vitro between said polypeptide and the antibodies which may be present in the biological sample, and detecting in vitro the antigen-antibody complexes which may be formed.

The polypeptides according to the invention may also and advantageously be used in a method for the detection of an infection by a bacterium of the *Mycobacterium tuberculosis* complex in a mammal based on the in vitro detection of a cellular reaction indicating prior sensitization of the mammal to said polypeptide such as for example cell proliferation, the synthesis of proteins such as interferon-gamma. This method for the detection of an infection by a bacterium of the *Mycobacterium tuberculosis* complex in a mammal is characterized in that it comprises the following steps:

a) preparation of a biological sample containing cells of said mammal, more particularly cells of the immune system of said mammal and still more particularly T cells;

b) incubation of the biological sample of step a) with a polypeptide according to the invention;

c) detection of a cellular reaction indicating prior sensitization of the mammal to said polypeptide such as for example cell proliferation and/or the synthesis of proteins such as interferon-gamma.

Cell proliferation may be measured, for example, by incorporation of $^3$H-Thymidine.

Also forming part of the invention are the methods for the detection of a delayed hypersensitivity reaction (DTH), characterized in that they use a polypeptide according to the invention Preferably, the biological sample consists of a fluid, for example a human or animal serum, blood, biopsies, bronchoalveolar fluid or pleural fluid.

Any conventional procedure may be used to carry out such a detection.

By way of example, a preferred method uses immunoenzymatic procedures such as the ELISA, immunofluorescence or radioimmunoassay (RIA) technique and the like.

Thus, the invention also relates to the polypeptides according to the invention, labeled with the aid of a suitable marker of the enzymatic, fluorescent or radioactive type.

Such methods comprise, for example, the following steps:

deposition of predetermined quantities of a polypeptide composition according to the invention into the wells of a microtiter plate, introduction into said wells of increasing dilutions of serum or of another biological sample as defined above, before being analyzed, incubation of the microplate, introduction into the wells of the microtiter plate of labeled antibodies directed against human or animal immunoglobulins, the labeling of these antibodies having been carried out with the aid of an enzyme selected from those which are capable of hydrolyzing a substrate while modifying its radiation absorption, at least at a defined wavelength, for example at 550 nm, detection, by comparing with a control, of the quantity of substrate hydrolyzed.

The invention also relates to a box or kit for the in vitro diagnosis of an infection by a *mycobacterium* belonging to the *Mycobacterium tuberculosis* complex, comprising:

a polypeptide according to the invention, where appropriate, the reagents for constituting the medium which is appropriate for the immunological or specific reaction, the reagents allowing the detection of the antigen-antibody complexes produced by the immunological reaction which may be present in the biological sample, and the in vitro detection of the antigen-antibody complexes which may be formed, it being possible for these reagents to also carry a marker, or to be capable of being recognized in turn by a labeled reagent, more particularly in the case where the polypeptide according to the invention is not labeled, where appropriate, a reference biological sample (negative control) free of antibodies recognized by a polypeptide according to the invention, where appropriate, a reference biological sample (positive control) containing a predetermined quantity of antibodies recognized by a polypeptide according to the invention.

The polypeptides according to the invention make it possible to prepare monoclonal or polyclonal antibodies which are characterized in that they recognize specifically the polypeptides according to the invention. The monoclonal antibodies may be advantageously prepared from hybridomas according to the technique described by Kohler and Milstein in 1975. The polyclonal antibodies may be prepared, for example, by immunizing an animal, in particular a mouse, with a polypeptide according to the invention combined with an immune response adjuvant, and then purifying the specific antibodies contained in the serum of the immunized animals on an affinity column to which the polypeptide which served as antigen has been attached beforehand. The polyclonal antibodies according to the invention may also be prepared by purifying an affinity column, to which there have been immobilized beforehand a polypeptide according to the invention, antibodies contained in the serum of patients infected with a *mycobacterium* and preferably a bacterium belonging to the *Mycobacterium tuberculosis* complex.

The subject of the invention is also mono- or polyclonal antibodies or fragments thereof, or chimeric antibodies, characterized in that they are capable of recognizing specifically a polypeptide according to the invention.

The antibodies of the invention may also be labeled in the same manner as described above for the nucleic probes of the invention, such as a labeling of the enzymatic, fluorescent or radioactive type.

The invention relates, in addition, to a method for the specific detection of the presence of an antigen of a *mycobacterium* and preferably a bacterium of the *Mycobacterium tuberculosis* complex in a biological sample, characterized in that it comprises the following steps:

a) bringing the biological sample (biological tissue or fluid) collected from an individual into contact with a mono- or polyclonal antibody according to the invention, under conditions allowing an immunological reaction in vitro between said antibodies and the polypeptides specific to mycobacteria and preferably bacteria of the *Mycobacterium tuberculosis* complex which may be present in the biological sample, and b) detection of the antigen-antibody complex formed.

Also coming within the scope of the invention is a box or kit for the in vitro diagnosis, on a biological sample, of the presence of strains of mycobacteria and preferably of bacteria belonging to the *Mycobacterium tuberculosis* complex, preferably *M. tuberculosis*, characterized in that it comprises:

a polyclonal or monoclonal antibody according to the invention, labeled where appropriate;

where appropriate, a reagent for constituting the medium which is appropriate for carrying out the immunological reaction;

a reagent allowing the detection of the antigen-antibody complexes produced by the immunological reaction, it being possible for this reagent to also carry a marker, or to be capable of being recognized in turn by a labeled reagent, more particularly in the case where said monoclonal or polyclonal antibody is not labeled;

where appropriate, reagents for carrying out the lysis of the cells of the sample tested.

The subject of the present invention is also a method for the detection and rapid identification of the mycobacteria and preferably of the *M. tuberculosis* bacteria in a biological sample, characterized in that it comprises the following steps:

a) isolation of the DNA from the biological sample to be analyzed, or production of a cDNA from the RNA of the biological sample;

b) specific amplification of the DNA of mycobacteria and preferably of bacteria belonging to the *Mycobacterium tuberculosis* complex with the aid of primers according to the invention;

c) analysis of the products of amplification.

The products of amplification may be analyzed by various methods.

Two methods of analysis are given by way of example below:

agarose gel electrophoretic analysis of the products of amplification. The presence of a DNA fragment which migrates to the expected position suggests that the sample analyzed contained DNA of mycobacteria belonging to the tuberculosis complex, or analysis by the molecular hybridization technique using a nucleic probe according to the invention. This probe will be advantageously labeled with a nonradioactive (cold probe) or radioactive element.

For the purposes of the present invention, "DNA of the biological sample" or "DNA contained in the biological sample" is understood to mean either the DNA present in the biological sample considered, or the cDNA obtained after the action of a reverse transcriptase-type enzyme on the RNA present in said biological sample.

Another method of the present invention allows the detection of an infection by a *mycobacterium* and preferably a bacterium of the *Mycobacterium tuberculosis* complex in a mammal. This method comprises the following steps:

a) preparation of a biological sample containing cells of said mammal, more particularly cells of the immune system of said mammal and still more particularly T cells;

b) incubation of the biological sample of step a) with a polypeptide according to the invention;

c) detection of a cellular reaction indicating prior sensitization of the mammal to said polypeptide in particular cell proliferation and/or the synthesis of proteins such as interferon-gamma;

d) detection of a reaction of delayed hypersensitivity or of sensitization of the mammal to said polypeptide.

This method of detection is an intradermal method which is described for example by M. J. Elhay et al. (1988) Infection and Immunity, 66(7): 3454-3456.

Another aim of the present invention consists in a method for the detection of the mycobacteria and preferably the bacteria belonging to the *Mycobacterium tuberculosis* complex in a biological sample, characterized in that it comprises the following steps:

a) bringing an oligonucleotide probe according to the invention into contact with a biological sample, the DNA contained in the biological sample, or the cDNA obtained by reverse transcription of the RNA of the biological sample, having, where appropriate, been made accessible to the hybridization beforehand, under conditions allowing the hybridization of the probe with the DNA or the cDNA of the mycobacteria and preferably of the bacteria of the *Mycobacterium tuberculosis* complex;

b) detection of the hybrid formed between the oligonucleotide probe and the DNA of the biological sample.

The invention also relates to a method for the detection of the mycobacteria and preferably of the bacteria belonging to the *Mycobacterium tuberculosis* complex in a biological sample, characterized in that it comprises the following steps:

a) bringing an oligonucleotide probe according to the invention, immobilized on a support, into contact with a biological sample, the DNA of the biological sample having, where appropriate, been made accessible to the hybridization beforehand, under conditions allowing the hybridization of said probe with the DNA of the mycobacteria and preferably of the bacteria of the *Mycobacterium tuberculosis* complex;

b) bringing the hybrid formed between said oligonucleotide probe immobilized on a support and the DNA contained in the biological sample, where appropriate after removal of the DNA of the biological sample which has not hybridized with the probe, into contact with a labeled oligonucleotide probe according to the invention.

According to an advantageous embodiment of the method of detection defined above, it is characterized in that, prior to step a), the DNA of the biological sample is amplified beforehand with the aid of a pair of primers according to the invention.

Another embodiment of the method of detection according to the invention consists in a method for the detection of the presence of the mycobacteria and preferably the bacteria belonging to the *Mycobacterium tuberculosis* complex in a biological sample, characterized in that it comprises the following steps:

a) bringing the biological sample into contact with a pair of primers according to the invention, the DNA contained in the sample having been, where appropriate, made accessible to hybridization beforehand, under conditions allowing hybridization of said primers with the DNA of the mycobacteria and preferably of the bacteria of the *Mycobacterium tuberculosis* complex;

b) amplification of the DNA of a *mycobacterium* and preferably of a bacterium of the *Mycobacterium tuberculosis* complex;

c) detection of the amplification of the DNA fragments corresponding to the fragment flanked by the primers, for example by gel electrophoresis or by means of an oligonucleotide probe according to the invention.

A subject of the invention is also a method for the detection of the presence of the mycobacteria and preferably the bacteria belonging to the *Mycobacterium tuberculosis* complex in a biological sample by strand displacement, characterized in that it comprises the following steps:

a) bringing the biological sample into contact with two pairs of primers according to the invention specifically intended for amplification of the SDA type described above, the DNA content in the sample having been, where appropriate, made accessible to hybridization beforehand, under conditions allowing hybridization of the primers with the DNA of the mycobacteria and preferably the bacteria of the *Mycobacterium tuberculosis* complex;

b) amplification of the DNA of the mycobacteria and preferably of the bacteria of the *Mycobacterium tuberculosis* complex;

c) detection of the amplification of DNA fragments corresponding to the fragment flanked by the primers, for example by gel electrophoresis or by means of an oligonucleotide probe according to the invention.

The invention also relates to a box or kit for carrying out the method described above, intended for the detection of the presence of the mycobacteria and preferably the bacteria of the *Mycobacterium tuberculosis* complex in a biological sample, characterized in that it comprises the following components:

a) an oligonucleotide probe according to the invention;

b) the reagents necessary for carrying out a hybridization reaction;

c) where appropriate, a pair of primers according to the invention as well as the reagents necessary for a reaction of amplification of the DNA (genomic DNA, plasmid DNA or cDNA) of mycobacteria and preferably of bacteria of the *Mycobacterium tuberculosis* complex.

The subject of the invention is also a kit or box for the detection of the presence of the mycobacteria and preferably the bacteria of the *Mycobacterium tuberculosis* complex in a biological sample, characterized in that it comprises the following components:

a) an oligonucleotide probe, termed capture probe, according to the invention;

b) an oligonucleotide probe, termed revealing probe, according to the invention;

c) where appropriate, a pair of primers according to the invention as well as the reagents necessary for a reaction of amplification of the DNA of mycobacteria and preferably of bacteria of the *Mycobacterium tuberculosis* complex.

The invention also relates to a kit or box for the amplification of the DNA of the mycobacteria and preferably the bacteria of the *Mycobacterium tuberculosis* complex present in a biological sample, characterized in that it comprises the following components:

a) a pair of primers according to the invention;

b) the reagents necessary for carrying out a DNA amplification reaction;

c) optionally, a component which makes it possible to verify the sequence of the amplified fragment, more particularly an oligonucleotide probe according to the invention.

Another subject of the present invention relates to an immunogenic composition, characterized in that it comprises a polypeptide according to the invention.

Another immunogenic composition according to the invention is characterized in that it comprises one or more polypeptides according to the invention and/or one or more hybrid polypeptides according to the invention.

According to an advantageous embodiment, the above-defined immunogenic composition constitutes a vaccine when it is provided in combination with a pharmaceutically acceptable vehicle and optionally one or more immunity adjuvants such as alum or a representative of the family of muramyl peptides or alternatively incomplete Freund's adjuvant.

Various types of vaccine are currently available for protecting humans against infectious diseases: attenuated live microorganisms (*M. bovis*-BCG for tuberculosis), inactivated microorganisms (influenza virus), acellular extracts (*Bordetella pertussis* for whooping cough), recombinant proteins (hepatitis B virus surface antigen), polysaccharides (pneumococci). Experiments are being carried out on vaccines prepared from synthetic peptides or genetically modified microorganisms expressing heterologous antigens. More recently still, recombinant plasmid DNAs carrying genes encoding protective antigens have been proposed as an alternative vaccine strategy. This type of vaccination is carried out with a specific plasmid which is derived from an *E. coli* plasmid which does not replicate in vivo and which encodes only the vaccinal protein. The principal functional components of this plasmid are: a strong promoter allowing expression in eukaryotic cells (for example that of CMV), an appropriate cloning site for inserting the gene of interest, a termination-polyadenylation sequence, a prokaryotic replication origin for producing the recombinant plasmid in vitro and a selectable marker (for example the ampicillin-resistance gene) for facilitating the selection of the bacteria which contain the plasmid. Animals were immunized by simply injecting the naked plasmid DNA into the muscle. This technique leads to the expression of the vaccinal protein in situ and to an immune response in particular of the cellular type (CTL) and of the humoral type (antibody). This double induction of the immune response is one of the main advantages of the vaccination technique with naked DNA. Huygen et al. (1996) and Tascon et al. (1996) succeeded in obtaining a degree of protection against *M. tuberculosis* by injecting recombinant plasmids containing *M. leprae* genes (hsp65, 36kDa pra) as inserts. *M. leprae* is the agent responsible for leprosy. The use of an insert specific to *M. tuberculosis* such as, for example, the whole or part of the DP428 gene, which is the subject of the present invention, would probably lead to a better protection against tuberculosis. The whole or part of the DP428 gene, or any polynucleotide according to the invention, can be easily inserted into the plasmid vectors V1J (Montgomery et al., 1993), pcDNA3 (Invitrogen, R & D Systems) or pcDNA1/Neo (Invitrogen) which possess the necessary characteristics for a vaccinal use.

The invention thus relates to a vaccine, characterized in that it comprises one or more polypeptides according to the invention and/or one or more hybrid polypeptides according to the invention as previously defined, in combination with a pharmaceutically compatible vehicle and, where appropriate, one or more appropriate immunity adjuvants.

The invention also relates to a vaccine composition intended for the immunization of humans or animals against a bacterial or viral infection, such as tuberculosis or hepatitis, characterized in that it comprises one or more hybrid polypeptides as previously defined in combination with a pharmaceutically compatible vehicle and, where appropriate, one or more immunity adjuvants.

Advantageously, in the case of a protein which is a hybrid between a polypeptide according to the invention and the hepatitis B surface antigen, the vaccine composition will be administered, in humans, in an amount of 0.1 to 1 µg of purified hybrid protein per kilogram of the weight of the patient, preferably 0.2 to 0.5 µg/kg of the weight of the patient, for a dose intended for a given administration. In the case of patients suffering from disorders of the immune system, in particular immunosuppressed patients, each injected dose will preferably contain half of the quantity, by weight, of the hybrid protein contained in a dose intended for a patient not suffering from immune system disorders.

Preferably, the vaccine composition will be administered several times, spread out over time, by the intradermal or subcutaneous route. By way of example, three doses as defined above will be administered, respectively, to the patient at time t0, at time t0+1 month and at time t0+1 year.

Alternatively, three doses will be administered, respectively, to the patient at time t0, at time t0+1 month and at time t0+6 months.

In mice, in which a weight dose of the vaccine composition comparable to the dose used in humans is administered, the antibody reaction is tested by collecting serum followed by a study of the formation of a complex between the antibodies present in the serum and the antigen of the vaccine composition, according to the customary techniques.

The invention also relates to an immunogenic composition characterized in that it comprises a polynucleotide or an expression vector according to the invention, in combination with a vehicle allowing its administration to humans or animals.

The subject of the invention is also a vaccine intended for immunizing against a bacterial or viral infection, such as tuberculosis or hepatitis, characterized in that it comprises a polynucleotide or an expression vector according to the invention, in combination with a pharmaceutically acceptable vehicle.

Such immunogenic or vaccine compositions are in particular described in international application No. WO 90/11092 (Vical Inc.) and also in international application No. WO 95/11307 (Institut Pasteur).

The constituent polynucleotide of the immunogenic composition or of the vaccine composition according to the invention may be injected into the host after having been coupled with compounds which promote the penetration of this polynucleotide into the cell or its transport to the cell nucleus. The resulting conjugates may be encapsulated into polymer microparticles, as described in international application No. WO 94/27238 (Medisorb Technologies International).

According to another embodiment of the immunogenic and/or vaccine composition according to the invention, the polynucleotide, preferably a DNA, is complexed with DEAE-dextran (Pagano et al., 1967) or with nuclear proteins (Kaneda et al., 1989), with lipids (Felgner et al., 1987) or encapsulated into liposomes (Fraley et al., 1980).

According to yet another advantageous embodiment of the immunogenic and/or vaccine composition according to the invention, the polynucleotide according to the invention may be introduced in the form of a gel facilitating its transfection into cells. Such a composition in gel form may be a poly-L-lysine and lactose complex, as described by Midoux in 1993, or Poloxamer 407™, as described by Pastore in 1994. The polynucleotide or the vector according to the invention may also be in suspension in a buffer solution or may be combined with liposomes.

Advantageously, such a vaccine will be prepared in accordance with the technique described by Tacson et al. or Huygen et al. in 1996 or in accordance with the technique described by Davis et al. in international application No. WO 95/11307 (Whalen et al.).

Such a vaccine will be advantageously prepared in the form of a composition containing a vector according to the invention, placed under the control of regulatory elements allowing its expression in humans or animals.

To produce such a vaccine, the polynucleotide according to the invention is first of all subcloned into an appropriate expression vector, particularly an expression vector containing regulatory and expression signals recognized by the enzymes in eukaryotic cells and also containing a replication origin which is active in prokaryotes, for example in E. coli, which allows its prior amplification. The purified recombinant plasmid obtained is then injected into the host, for example by the intramuscular route.

It will be possible, for example, to use as vector for expressing in vivo the antigen of interest the plasmid pcDNA3 or the plasmid pcDNA1/neo, both marketed by Invitrogen (R&D Systems, Abingdon, United Kingdom). It is also possible to use the plasmid V1Jns.tPA described by Shiver et al. in 1995.

Such a vaccine will advantageously comprise, in addition to the recombinant vector, a saline solution, for example a sodium chloride solution.

A vaccine composition as defined above will be, for example, administered by the parenteral route or by the intramuscular route.

The present invention also relates to a vaccine characterized in that it contains one or more nucleotide sequences according to the invention and/or one or more polynucleotides as mentioned above in combination with a pharmaceutically compatible vehicle and, where appropriate, one or more appropriate immunity adjuvants.

Another aspect relates to a method of screening molecules capable of inhibiting the growth of mycobacteria or the maintenance of mycobacteria in a host, characterized in that said molecules block the synthesis or the function of the polypeptides encoded by a nucleotide sequence according to the invention or by a polynucleotide as described supra.

In said method of screening, the molecules may be anti-messengers or may induce the synthesis of anti-messengers.

The present invention also relates to molecules capable of inhibiting the growth of mycobacteria or the maintenance of mycobacteria in a host, characterized in that said molecules are synthesized based on the structure of the polypeptides encoded by a nucleotide sequence according to the invention or by a polynucleotide as described supra.

Other characteristics and advantages of the invention appear in the following examples and figures:

FIGURES

The FIG. 1 Series:

The FIG. 1 series illustrates the series of nucleotide sequences SEQ ID NOS: 1, 8, 14, 25, 31, and 33 corresponding to the insert of the vector pDP428 (deposited at the CNCM under the No. I-1818) and the series of amino acid sequences SEQ ID NOS: 2-7, 9-13, 15-24, 26-30, 32, 34 of the polypeptides encoded by the series of nucleotide sequences SEQ ID NOS: 1, 8, 14, 25, 31, and 33.

FIG. 2:

Illustrates the nucleotide sequence SEQ ID NO: 35 corresponding to the region including the gene encoding the polypeptide DP428 (region underlined). Both the ATG and GTG codons for initiation of translation were taken into account in this figure. The figure shows that the polypeptide DP428 is probably part of an operon comprising at least three genes. The double-boxed region probably includes the promoter regions.

The single-boxed region corresponds to the motif LPISG (SEQ ID NO: 934) which resembles the motif LPXTG (SEQ ID NO: 935) described in Gram-positive bacteria as allowing anchorage to peptidoglycans.

The FIG. 3 Series:

The FIG. 3 series represents the series of nucleotide sequences SEQ ID NOS: 41, 46, 52 corresponding to the insert of the vector p6D7 (deposited at the CNCM under the No. I-1814) and the series of amino acid sequences SEQ ID NOS: 42-45, 47-51, and 53-55.

The FIG. 4 Series:

The FIG. 4 series represents the series of nucleotide sequences SEQ ID NOS: 56, 62, 64, 67, 69, 72, 74, 76, 78, 81, 84, and 86 corresponding to the insert of the vector p5A3 (deposited at the CNCM under the No. I-1815) and the series of amino acid sequences SEQ ID NOS: 57-61, 63, 65-66, 68, 70-71, 73, 75, 77, 79-80, 82-83, 85, and 87.

The FIG. 5 Series:

The FIG. 5 series represents the series of nucleotide sequences SEQ ID NOS: 88, 90, 92, 96, 98, 100, 104, 106, and 108 corresponding to the insert of the vector p5F6 (deposited at the CNCM under the No. I-1816) and the series of amino acid sequences SEQ ID NOS: 93-95, 97, 99, 101-103, 105, 107, and 109.

The FIG. 6 Series:

The FIG. 6 series represents the series of nucleotide sequences SEQ ID NOS: 110, 113, and 119 corresponding to the insert of the vector p2A29 (deposited at the CNCM under the No. I-1817) and the series of amino acid sequences SEQ ID NOS: 111-112, 114-118, and 120-121.

The FIG. 7 Series:

The FIG. 7 series represents the series of nucleotide sequences SEQ ID NOS: 122, 128, and 133 corresponding to the insert of the vector p5B5 (deposited at the CNCM under the No. I-1819) and the series of amino acid sequences SEQ ID NOS: 123-127, 129-132, and 134-136.

The FIG. 8 Series:

The FIG. 8 series represents the series of nucleotide sequences SEQ ID NOS: 137, 139, 141, 143, 145, 148, 150, 152, 154, and 156 corresponding to the insert of the vector p1C7 (deposited at the CNCM under the No. I-1820) and the series of amino acid sequences SEQ ID NOS: 138, 272-273, 140, 142, 144, 146-147, 149, 151, 153, 155, and 157.

The FIG. 9 Series:

The FIG. 9 series represents the series of nucleotide sequences SEQ ID NOS: 158, 160, and 162 corresponding to the insert of the vector p2D7 (deposited at the CNCM under the No. I-1821) and the series of amino acid sequences SEQ ID NOS: 159, 161, 163, and 164.

The FIG. 10 Series:

The FIG. 10 series represents the series of nucleotide sequences SEQ ID NOS: 165, 169, and 177 corresponding to the insert of the vector p1B7 (deposited at the CNCM under the No. I-1843) and the series of amino acid sequences SEQ ID NOS: 166-168, 170-176, 178-183.

The FIG. 11 Series:

The FIG. 11 series represents the series of nucleotide sequences SEQ ID NOS: 184, 189, 195, 200, 202, 206, 209, and 211 and the series of amino acid sequences SEQ ID NOS: 185-188, 190-194, 196-199, 201, 203-205, 207-208, 210, and 212.

The FIG. 12 Series:

The FIG. 12 series represents the series of nucleotide sequences SEQ ID NOS: 213, 217, and 220 and the series of amino acid sequences SEQ ID NOS: 214-216, 218-219, and 221-224.

The FIG. 13 Series:

The FIG. 13 series represents the series of nucleotide sequences SEQ ID NOS: 225, 228, 238, 246, 250, 255, 258, and 260 and the series of amino acid sequences SEQ ID NOS: 226-227, 923-925, 229-237, 239-245, 247-249, 251-254, 256-257, 259, and 261.

The FIG. 14 Series:

The FIG. 14 series represents the series of nucleotide sequences SEQ ID NOS: 262, 268, 274, 278, 280, 282, 284, 286, 288, 297, 290, and 310 corresponding to the insert of the vector p5B5 (deposited at the CNCM under the No. I-1819) and the series of amino acid sequences SEQ ID NOS: 263-267, 269-271, 275-277, 279, 281, 283, 285, 287, 289, 291-296, 298-309, and 311-316.

The FIG. 15 Series:

The FIG. 15 series represents the series of nucleotide sequences SEQ ID NOS: 317, 321, 323, 325, 327, 331, 333, 335, 337, 339, 346, and 347 and the series of amino acid sequences SEQ ID NOS: 318-320, 322, 324, 326, 328-330, 332, 334, 336, 338, 340-345, and 348-352.

The FIG. 16 Series:

The FIG. 16 series represents the series of nucleotide sequences SEQ ID NOS: 353, 357, and 359 and the series of amino acid sequences SEQ ID NOS: 354-356, 358, 360, and 926-930.

The FIG. 17 Series:

The FIG. 17 series represents the series of nucleotide sequences SEQ ID NOS: 361, 364, 368, 371, 374, 380, 383, and 385 and the series of amino acid sequences SEQ ID NOS: 362-363, 365-367, 369-370, 372, 373, 375-379, 381-382, 384, and 386.

The FIG. 18 Series:

The FIG. 18 series represents the series of nucleotide sequences SEQ ID NOS: 387, 389, 393, 395, 397, 399, 403, and 405 and the series of amino acid sequences SEQ ID NOS: 388, 390-392, 394, 396, 398, 400-402, 404, and 406.

The FIG. 19 Series:

The FIG. 19 series represents the series of nucleotide sequences SEQ ID NOS: 407, 410, 412, 419, 421, 426, 429, and 431 and the series of amino acid sequences SEQ ID NOS: 408-409, 411, 413-418, 420, 422-425, 427-428, 430, and 432.

The FIG. 20 Series:

The FIG. 20 series represents the series of nucleotide sequences SEQ ID NOS: 433, 437, 441, 447, 452, 456, 459, and 461 corresponding to the insert of the vector p2A29 (deposited at the CNCM under the No. I-1817) and the series of amino acid sequences SEQ ID NOS: 434-436, 438-440, 442-446, 448-451, 453-455, 457-458, 460, and 462.

The FIG. 21 Series:

The FIG. 21 series represents the series of nucleotide sequences SEQ ID NOS: 463, 469, 472, 474, 476, 482, 485, and 487 and the series of amino acid sequences SEQ ID NOS: 464-468, 470, 471, 473, 475, 477-481, 483-484, 486, and 488.

The FIG. 22 Series:

The FIG. 22 series represents the series of nucleotide sequences SEQ ID NOS: 489, 495, and 497 and the series of amino acid sequences SEQ ID NOS: 490-494, 496, and 498-500.

The FIG. 23 Series:

The FIG. 23 series represents the series of nucleotide sequences SEQ ID NOS: 501, 505, and 510 and the series of amino acid sequences SEQ ID NOS: 502-504, 506-509, and 511-515.

The FIG. 24 Series:

The FIG. 24 series represents the series of nucleotide sequences SEQ ID NOS: 516, 519, and 522 and the series of amino acid sequences SEQ ID NOS: 517-518, 520-521, and 523-527.

FIGS. 25 and 26:

FIGS. 25 and 26 illustrate, respectively, the sequences SEQ ID NO: 528 and SEQ ID NO: 529 representing a pair of primers used to specifically amplify, by PCR, the region corresponding to nucleotides 964 to 1234 included in the sequence SEQ ID NOS: 1, 8, 14, 25, 31, and 33.

The FIG. 27 Series:

The FIG. 27 series represents the series of nucleotide sequences SEQ ID NOS: 530, 534, and 537 corresponding to the insert of the vector p5A3 and the series of amino acid sequences SEQ ID NOS: 531-533, 535-536, and 538-542.

FIG. 28:

The amino acid sequence as defined in FIG. 28 represents the amino acid sequence SEQ ID NO: 543 corresponding to the polypeptide DP428.

FIG. 29:

FIG. 29 represents the nucleotide sequence SEQ ID NO: 544 of the complete gene encoding the M1C25 protein.

FIG. 30:

FIG. 30 represents the amino acid sequence SEQ ID NO: 545 of the M1C25 protein.

The FIG. 31 Series:

The FIG. 31 series represents the series of nucleotide sequences SEQ ID NOS: 546, 550, 552, and 554 and the series of amino acid sequences SEQ ID NOS: 547-549, 551, 553, and 555.

The FIG. 32 Series:

The FIG. 32 series represents the series of nucleotide sequences SEQ ID NOS: 556, 558, 564, 569, and 571 and the series of amino acid sequences SEQ ID NOS: 557, 559-563, 565-568, 570, and 572.

The FIG. 33 Series:

The FIG. 33 series represents the series of nucleotide sequences SEQ ID NOS: 573, 576, 580, 584, and 586 and the series of amino acid sequences SEQ ID NOS: 574-575, 577-579, 581-583, 585, and 587.

The FIG. 34 Series:

The FIG. 34 series represents the series of nucleotide sequences SEQ ID NOS: 588, 590, 594, and 596 and the series of amino acid sequences SEQ ID NOS: 587, 589, 591-593, 595, and 597.

The FIG. 35 Series:

The FIG. 35 series represents the series of nucleotide sequences SEQ ID NOS: 598, 600, 604, 608, and 610 and the series of amino acid sequences SEQ ID NOS: 599, 601-603, 605-607, 609, and 611.

The FIG. 36 Series:

The FIG. 36 series represents the series of nucleotide sequences SEQ ID NOS: 612, 614, 616, 618, nd 620 and the series of amino acid sequences SEQ ID NOS: 613, 615, 617, 619, and 621.

The FIG. 37 Series:

The FIG. 37 series represents the series of nucleotide sequences SEQ ID NOS: 622, 624, 626, 629, and 631 and the series of amino acid sequences 623, 625, 627-628, 630, and 632.

The FIG. 38 Series:

The FIG. 38 series represents the series of nucleotide sequences SEQ ID NOS: 633, 635, 640, 647, and 649, and the series of amino acid sequences SEQ ID NOS: 634, 636-639, 641-646, 648, and 650.

The FIG. 39 Series:

The FIG. 39 series represents the series of nucleotide sequences SEQ ID NOS: 651, 653, 657, 660, and 662 and the series of amino acid sequences SEQ ID NOS: 652, 654-656, 658-659, 661, and 663.

The FIG. 40 Series:

The FIG. 40 series represents the series of nucleotide sequences SEQ ID NOS: 664, 666, 669, 674, and. 676, and the series of amino acid sequences SEQ ID NOS: 665, 931-933, 667-668, 670-673, 675, and 677.

The FIG. 41 Series:

The FIG. 41 series represents the series of nucleotide sequences SEQ ID NOS: 678, 683, 686, 691, 693, 695, 697, 702, and 717 corresponding to the insert of the vector p2D7 (deposited at the CNCM under the No. I-1821) and the series of amino acid sequences SEQ ID NOS: 679-682, 684, 685, 687-690, 692, 694, 696, 698-701, 703-716, and 718-727.

The FIG. 42 Series:

The FIG. 42 series represents the series of nucleotide sequences SEQ ID NOS: 728, 733, 736, 739, and 741 and the series of amino acid sequences SEQ ID NOS: 729-732, 734-735, 737-738, 740, and 742.

The FIG. 43 Series:

The FIG. 43 series represents the series of nucleotide sequences SEQ ID NOS: 743, 746, 752, 755, and 757 and the series of amino acid sequences SEQ ID NOS: 744-745, 747-751, 753-754, 756, and 758.

The FIG. 44 Series:

The FIG. 44 series represents the series of nucleotide sequences SEQ ID NOS: 759, 761, 764, 767, and 769, and the series of amino acid sequences SEQ ID NOS: 760, 762, 763, 765-766, 768, and 770.

The FIG. 45 Series:

The FIG. 45 series represents the series of nucleotide sequences SEQ ID NOS: 771, 784, 794, 805, 807, and 809 and the series of amino acid sequences SEQ ID NOS: 772-783, 785-793, 795-804, 806, 808, and 810.

The FIG. 46 Series:

The FIG. 46 series represents the series of nucleotide sequences SEQ ID NOS: 811, 813, 817, 821, and 823 and the series of amino acid sequences SEQ ID NOS: 812, 814-816, 818-820, 822, and 824.

The FIG. 47 Series:

The FIG. 47 series represents the series of nucleotide sequences SEQ ID NOS: 825, 827, 831, 833, and 835 and the series of amino acid sequences SEQ ID NOS: 826, 828-830, 832, 834, and 836.

The FIG. 48 Series:

The FIG. 48 series represents the series of nucleotide sequences SEQ ID NOS: 837, 839, 842, 844, and 846 and the series of amino acid sequences SEQ ID NOS: 838, 840-841, 843, 845, and 847.

The FIG. 49 Series:

The FIG. 49 series represents the series of nucleotide sequences SEQ ID NOS: 848, 864, 878, 883, and 885 and the series of amino acid sequences SEQ ID NOS: 849-863, 865-877, 879, 880-882, 884, and 886.

The FIG. 50 Series:

The FIG. 50 series represents the series of nucleotide sequences SEQ ID NOS: 887, 895, 901, 907, and 909 and the series of amino acid sequences SEQ ID NOS: 888-894, 896-900, 902-906, 908, and 910.

FIG. 51:

A. Construct pJVED: shuttle plasmid (capable of multiplying in mycobacteria as well as in *E. coli*) with a kanamycin-resistance gene (derived from Tn903) as a selectable marker. The truncated phoA gene (ΔphoA) and the luc gene form a synthetic operon.

B. Joining sequence (SEQ ID NO: 922) between phoA and luc.

FIG. 52:

Genomic hybridization (Southern blotting) of the genomic DNA of various mycobacterial species with the aid of an oligonucleotide probe whose sequence is the sequence between the nucleotide at position nt 964 (5' end of the probe) and the nucleotide at position nt 1234 (3' end of the probe), ends included, of the sequence SEQ ID NOS: 1, 8, 14, 25, 31, and 33.

Figure 52:
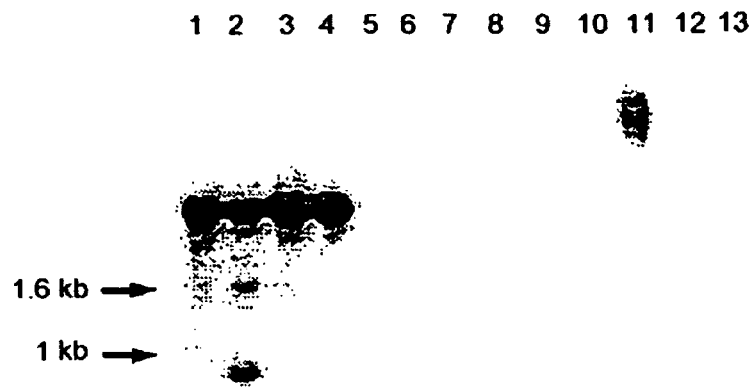
Figure 53:
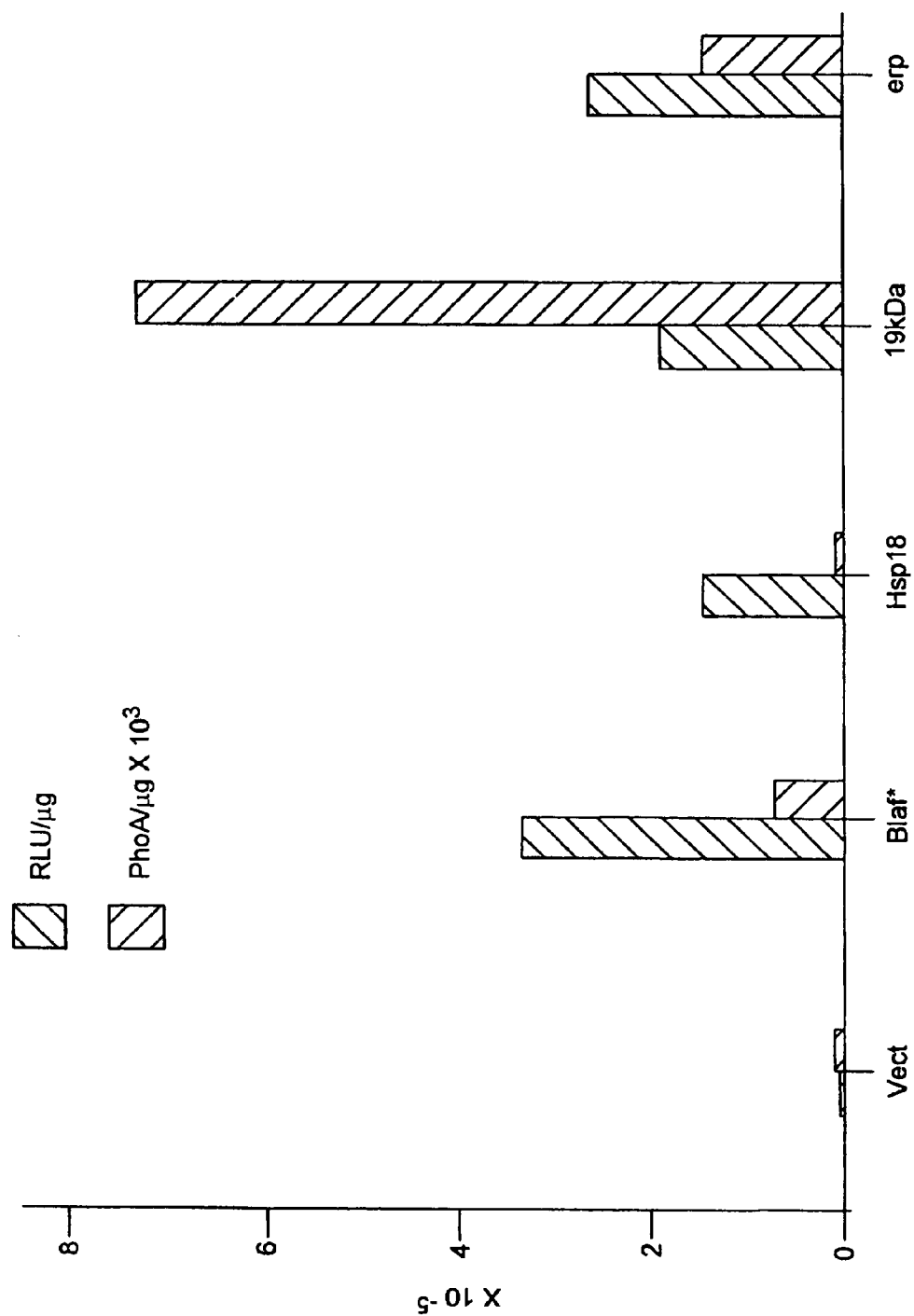

FIGS. 53 and 54:

Recombinant *M. smegmatis* Luc and PhoA activities containing pJVED with various nucleotide fragments as described in the examples. FIGS. 52 and 53 represent the results obtained for two separate experiments carried out under the same conditions.

FIG. 55:

Representation of the hydrophobicity (Kyte and Doolitle) of the coding sequence of the polypeptide DP428 with its schematic representation. The LPISG (SEQ ID NO: 934) motif immediately precedes the hydrophobic C-terminal region. The sequence ends with two arginines.

FIG. 56:

Representation of the hydrophobicity (Kyte and Doolitle) of the sequence of the polypeptide M1C25 having the amino acid sequence SEQ ID NO: 545.

FIG. 57:

A—Acrylamide gel (12%) under denaturing conditions of a bacterial extract obtained by sonication of *E. coli* M15 bacteria containing the plasmid pM1C25 without and after 4 hours of induction with IPTG, stained with Coomassie Blue.

Lane 1: Molecular weight marker (Prestained SDS-PAGE Standards High Range BIO-RAD®).

Lane 2: Bacterial extract obtained by sonication of *E. coli* M15 bacteria containing the plasmid pM1C25 without induction with IPTG.

Lane 3: Bacterial extract obtained by sonication of *E. coli* M15 bacteria containing the plasmid pM1C25 after 4 hours of induction with IPTG.

Lane 4: Molecular weight marker (Prestained SDS-PAGE Standards Low Range BIO-RAD®).

B—Western blotting of a similar gel (12% acrylamide) visualized by means of the penta-His antibody marketed by the company Quiagen.

Lane 1: Representation of the molecular weight marker (Prestained SDS-PAGE Standards High Range BIO-RAD®).

Lane 2: Bacterial extract obtained by sonication of *E. coli* M15 bacteria containing the plasmid pM1C25 without induction with IPTG.

Lane 3: Bacterial extract obtained by sonication of *E. coli* M15 bacteria containing the plasmid pM1C25 after 4 hours of induction with IPTG.

Lane 4: Representation of the molecular weight marker (Prestained SDS-PAGE Standards Low Range BIO-RAD®).

The band which is most predominantly present in the lanes corresponding to the bacteria induced with IPTG compared with those not induced with IPTG, between 34,200 and 28,400 daltons, corresponds to the expression of the insert M1C25 cloned into the vector pQE-60 (Qiagen®).

As regards the legend to the other figures which are numbered by an alphanumeric character, each of these other figures represents the nucleotide sequence and the amino acid sequence having the SEQ ID sequence whose numbering is identical to the alphanumeric character of each of said figures.

The alphanumeric numberings of the figures representing the SEQ IDs comprising a number followed by a letter have the following meanings:

the alphanumeric numberings having the same number relate to the same family of sequences attached to the reference SEQ ID sequence whose numbering has this same number and the letter A;

the letters A, B and C for the same family of sequences distinguish the three possible reading frames of the reference SEQ ID nucleotide sequence (A);

the letters with a prime (') index mean that the sequence corresponds to a fragment of the reference SEQ ID sequence (A);

the letter D means that the sequence corresponds to the sequence of the gene predicted by Cole et al., 1998;

the letter F means that the sequence corresponds to the open reading frame (ORF) containing the corresponding "D" sequence according to Cole et al., 1998;

the letter G means that the sequence is a sequence predicted by Cole et al., 1998, and exhibiting a homology of more than 70% with the reference SEQ ID sequence (A);

the letter H means that the sequence corresponds to the open reading frame containing the corresponding "G" sequence according to Cole et al., 1998;

the letter R means that the sequence corresponds to a sequence predicted by Cole et al., 1998, upstream of the corresponding "D" sequence and capable of being in phase with the sequence "D" because of possible sequencing errors;

the letter P means that the sequence corresponds to the open reading phase containing the corresponding "R" sequence;

the letter Q means that the sequence corresponds to a sequence containing the corresponding "F" and "P" sequences.

As regards the sequence family SEQ ID NOS: 56-87, the preceding insert phoA contains two fragments which are noncontiguous on the genome, SEQ ID NO: 76 and SEQ ID NO: 56, and which are therefore derived from a multiple cloning allowing the expression and export of phoA. These two noncontiguous fragments, the genes and the open reading frames containing them according to Cole et al., 1998, are important for the export of an antigenic polypeptide:

the letters J, K and L distinguish the three possible reading frames of the corresponding nucleotide sequence "J";

the letter M means that the sequence corresponds to the sequence predicted by Cole et al., 1998, and containing the sequence SEQ ID NO: 77;

the letter N means that the sequence corresponds to the open reading frame containing the sequence SEQ ID NO: 84.

As regards the sequence family SEQ ID NOS: 771-810, the letter Z means that the sequence corresponds to the sequence of a cloned fragment fused with phoA.

Finally, as regards the sequence family SEQ ID NOS: 678-727, the letter S means that the sequence corresponds to a sequence predicted by Cole et al., 1998 and which may be in the same reading frame as the corresponding sequence "D", the letter T meaning that the corresponding sequence contains the corresponding sequences "F" and "S".

EXAMPLES

Materials and Methods

Bacterial Cultures, Plasmids and Culture Media

E. coli was cultured on Luria-Bertani (LB) solid or liquid medium. M. smegmatis was cultured on Middlebrook 7H9 liquid medium (Difco) supplemented with albumin-dextrose (ADC), 0.2% glycerol and 0.05% Tween, or on solid L medium. If necessary, the antibiotic kanamycin was added at a concentration of 20 µg/ml. The bacterial clones having a PhoA activity were detected on LB agar containing 5-bromo-4-chloro-3-indolyl phosphate (X-P, at 40 µg/ml).

Manipulation of DNA and Sequencing

The manipulations of DNA and the Southern-blot analyses were carried out using the standard techniques (Sambrook et al., 1989). The double-stranded DNA sequences were determined with a Taq Dye Deoxy Terminator Cycle sequencing kit (Applied Biosystems), in a System 9600 GeneAmp PCR (Perkin-Elmer), and after migration on a model 373 DNA analyzing system (Applied Biosystems).

Constructions of the Plasmids

The plasmid pJVED$_a$ was constructed from pLA71, a transfer plasmid comprising the phoA gene which is truncated and placed in phase with BlaF. pLA71 was cleaved with the restriction enzymes KpnI and NotI, thus removing phoA without affecting the promoter of BlaF. The luc gene encoding the firefly luciferase was amplified from pGEM-luc and a ribosome-binding site was added. phoA was amplified from pJEM11. The amplified fragments were cleaved with PstI and ligated together. The oligodeoxynucleotides used are the following:

pPV.luc.Fw: 5'GACTGCTGCAGAAGGAGAAGATC-CAAATGG3' SEQ ID NO: 911)

luc.Bw: 5'GACTAGCGGCCGCGAATTCGTCGAC-CTCCGAGG3' (SEQ ID NO: 912)

pJEM.phoA.Fw: 5'CCGCGGATCCGGATACGTAC3' (SEQ ID NO: 913)

phoA.Bw: 5'GACTGCTGCAGTTTATTTCAGCCCCA-GAGCG3' (SEQ ID NO: 914).

The fragment thus obtained was reamplified using the oligonucleotides complementary to its ends, cleaved with KpnI and NotI, and integrated into pLA71 cleaved with the same enzymes. The resulting construct was electroporated into E. coli DH5α and M. smegmatis mc$^2$ 155. An M. smegmatis clone emitting light and having a phoA activity was selected and called pJVED/blaF. The insert was removed using BamHI and the construct closed again on itself, thus reconstructing pJVED$_a$. To obtain pJVED$_{b,c}$, the multiple cloning site was cleaved with ScaI and KpnI and closed again, removing one (pJVED$_b$) or two (pJVED$_c$) nucleotides from the SnaBI site. After fusion, it was thus possible to obtain six reading frames. The insert of pJVED/hsp18 was obtained by polymerase chain amplification (PCR) of pPM1745 (Servant et al., 1995) using oligonucleotides having the sequence:

18.Fw: 5'GTACCAGTACTGATCACCCGTCTCCCG-CAC3' (SEQ ID NO; 915)

18.Back: AGTCAGGTACCTCGCGGAAGGGGT-CAGTGCG3' (SEQ ID NO: 916)

The product was cleaved with KpnI and ScaI, and ligated to pJVED$_a$, cleaved with the same enzymes, thus leaving pJVED/hsp18.

pJVED/P19 kDa and pJVED/erp were constructed by cleaving with BamHl the insert of pExp410 and pExp53, respectively, and inserting them into the BamHl site of the multiple cloning site of pJVED$_a$.

Measurement of the Alkaline Phosphatase Activity

The presence of activity is detected by the blue color of the colonies growing on a culture medium containing the substrate 5-bromo-4-chloro-3-indolyl phosphate (XP), and then the activity can be quantitatively measured more precisely in the following manner:

M. smegmatis was cultured in an LB medium supplemented with 0.05% Tween 80 (Aldrich) and kanamycin (20 µg/ml) at 37° C. for 24 hours. The alkaline phosphatase activity was measured by the Brockman and Heppel method (Brockman et al., 1968) in a sonicated extract, with p-nitrophenyl phosphate as reaction substrate. The quantity of proteins was measured by the Bio-Rad assay. The alkaline phosphatase activity is expressed as arbitrary units (optic density at 420 nm×µg of protein$^{-1}$×minutes$^{-1}$).

Measurement of the Luciferase Activity

M. smegmatis was cultured in an LB medium supplemented with 0.05% Tween 80 (Aldrich) and kanamycin (20 µg/ml) at 37° C. for 24 hours and used in full exponential growth (OD at 600 nm between 0.3 and 0.8). The aliquots of bacterial suspensions were briefly sonicated and the cell extract was used to measure the luciferase activity. 25 µl of the sonicated extract were mixed with 100 µl of substrate (Promega luciferase assay system) automatically in a luminometer and the emitted light expressed in RLU (Relative Light Units). The bacteria were counted by serial dilutions of the origin suspension on LB-kanamycin agar medium and the luciferase activity expressed in RLU/µg of bacterial protein or in RLU10$^3$ bacteria.

Construction of M. tuberculosis and M. bovis-BCG Genomic Libraries

The libraries were obtained essentially using pJVED$_{a,b,c}$, which are described above.

Preparation of macrophages derived from bone marrow and infection with recombinant M. smegmatis.

The macrophages derived from bone marrow were prepared as described by Lang et al., 1991. In summary, the bone marrow cells were removed from the femur of 6- to 12-week old C57BL/6 mice (Iffa-Credo, France). The cells in suspensions were washed and resuspended in DMEM enriched with 10% fetal calf serum, 10% of conditioned L-cell medium and 2 mM glutamine, without antibiotics. 10$^6$ cells were inoculated on flat-bottomed 24-well Costar plates in 1 ml. After four days at 37° C. in a humid atmosphere containing a CO$_2$ content of 10%, the macrophages were rinsed and reincubated for an additional two to four days. The cells of a control well were lysed with triton ×100 at 0.1% in water and the nuclei enumerated. About 5×10$^5$ adherent cells were counted. For the infection, M. smegmatis carrying the different plasmids was cultured in full exponential phase (OD$_{600\,nm}$ between 0.4 and 0.8) and diluted to an OD of 0.1 and then 10-fold in a medium for macrophage. 1 ml was added to each well and the plates were centrifuged and incubated for four hours at 37° C. After three washes, the cells were incubated in a medium containing amikacin for two hours. After three new washes, the adherent infected cells were incubated in a macrophage medium overnight. The cells were then lysed in 0.5 ml of lysis buffer (Promega). 100 µl were sonicated and the light emitted was measured on 25 µm. Simultaneously, the bacteria were enumerated by spreading on L-agar-kanamycin (20 µg/ml). The light emitted is expressed in RLU/10$^3$ bacteria.

Analyses of the databanks

The nucleotide sequences were compared with EMBL and GenBank using the FASTA algorithm and the protein sequences were analyzed by similitude by means of the PIR and Swiss Prot databanks using the BLAST algorithm.

Example 1

The pJVED Vectors

The pJVED vectors (FIG. 51) are plasmids carrying an *E. coli* truncated phoA gene without initiation codon, signal sequence and regulatory sequence. The multiple cloning site (MCS) allows the insertion of fragments of the genes encoding potential exported proteins as well as their regulatory sequences. Consequently, the fusion protein may be produced and may exhibit an alkaline phosphatase activity if it is exported. Only the fusions in phase may be produced. Thus, the MCS was modified so that the fusions may be obtained in six reading frames. The firefly luciferase luc gene was inserted downstream of phoA. The complete gene with the initiation codon, but without any promoter having been used, thus ought to be expressed with phoA as in a synthetic operon. A new ribosome-binding site was inserted eight nucleotides upstream of the luc initiation codon. Two transcriptional terminators are present in the pJVED vectors, one upstream of the MCS and a second downstream of luc. These vectors are *E. coli-mycobacterium* transfer plasmids with a kanamycin-resistance gene as selectable marker.

phoA and luc function as in an operon, but export is necessary for the phoA activity.

Four plasmids were constructed by insertion into the MCS of DNA fragments of diverse origin:

In the first construct called pJVED/blaF, the 1.4 kb fragment is derived from the plasmid already described pLA71 (Lim et al., 1995). This fragment, derived from the β-lactamase gene (blaF) of *M. fortuitum* D216 (Timm et al., 1994), includes the hyperactive mutated promoter, the segment encoding 32 amino acids of the signal sequence and the first 5 amino acids of the mature protein. Thus, this construct includes the strongest promoter known in *mycobacterium* and the elements necessary for the export of the phoA fusion protein. Consequently, a strong light emission and a good phoA activity can be expected from this construct (cf. FIGS. 53 and 54).

Into a second construct called pJVED/hsp18, a 1.5 kb fragment was cloned from the plasmid already described pPM1745 (Servant et al., 1995). This fragment includes the nucleotides encoding the first ten amino acids of the 18 kb heat shock protein derived from *Streptomyces albus* (heat shock protein 18, HSP 18), the ribosome-binding site, the promoter and, upstream, regulatory sites controlling its expression. This protein belongs to the alpha-crystalline family of low-molecular weight HSP (Verbon et al., 1992). Its homolog, derived from *M. leprae,* the 18 kDa antigen, is already known to be induced during phagocytosis by a murine macrophage of the J-774 cell line (Dellagostinet et al., 1995). Under standard culture conditions, pJVED/hsp18 shows a weak luc activity and no phoA activity (cf. FIGS. 53 and 54).

In a third construct, called pJVED/P19 kDa, the insert derived from pExp410 (Lim et al., 1995) was cleaved and cloned into the MCS of pJVED$_a$. This fragment includes the nucleotides encoding the first 134 amino acids of the *M. tuberculosis* 19 kDa known protein and of its regulatory sequences. As has been demonstrated, this protein is a glycosylated lipoprotein (Garbe et al., 1993; Herrmann et al., 1996). In FIGS. 53 and 54, a good luc activity corresponding to a strong promoter is observed for this construct, but the phoA activity is the strongest of the four constructs. The high phoA activity of this fusion protein with a lipoprotein is explained by the fact that it remains attached to the cell wall by its N-terminal end.

In the fourth and last construct, called pJVED/erp, the insert is derived from pExp53 (Lim et al., 1995) and was cloned into the MCS of pJVED$_a$. pExp53 is the initial plasmid selected for its phoA activity and containing a portion of the *M. tuberculosis* erp gene which encodes a 28-kDa antigen. The latter includes the signal sequence, a portion of the mature protein and, upstream of the initiation codon, the ribosome-binding site. The promoter was mapped. A putative iron box of the fur type is present in this region and flanks the −35 region of the promoter (Berthet et al., 1995). As expected (FIGS. 53 and 54) this construct exhibits a good light emission and a good phoA activity. The fact that this fusion protein, unlike the fusion with the lipoprotein of 19 kDa, does not appear to be attached to the cell wall does not exclude that the native protein is combined with it. Furthermore, the C-terminal end of erp is absent from the fusion protein.

Example 2

Construction of an *M. tuberculosis* genomic DNA library in the pJVED$_s$ vectors and identification of one of the members of these libraries, (DP428), induced during phagocytosis by murine macrophages derived from bone marrow.

The various constructs were tested for their capacity to evaluate the intracellular expression of the genes identified by the expression of phoA. For this purpose, the luc activity is expressed in RLU for $10^3$ bacteria in axenic culture and/or under intracellular conditions. The induction or the repression following phagocytosis by the bone marrow-derived murine macrophages can be suitably evaluated by the measurement of specific activities. The results of two separate experiments are presented in Table 2.

The plasmid pJVED/hsp18 was used as positive control for the induction during the intracellular growth phase. Although the induction of the promoter by heating the bacterium at 42° C. was not conclusive, the phagocytosis of the bacterium clearly leads to an increase in the activity of the promoter. In all the experiments, the intracellular luc activity was strongly induced, increasing by 20 to 100-fold the initially weak basal activity (Servant, 1995).

The plasmid pJVED/blaF was used as a control for nonspecific modulation during the phagocytosis. It was possible to detect weak variations which were probably due to changes in culture conditions. Whatever the case, these weak variations are not comparable to the induction observed with the plasmid pJVED/hsp18.

All the members of the DNA library were tested by measuring the activity of the promoter during the intracellular growth. Among these, DP428 is strongly induced during phagocytosis (Tables 1 and 2).

TABLE 1

| Construct | % Recovery | RLU/10³ extracellular bacteria | RLU/10³ intracellular bacteria | Induction |
|---|---|---|---|---|
| pJVED/blaF* | 0.5 | 1460 | 1727 | 1.2 |
| pJVED/hsp18 | 0.6 | 8 | 57 | 7.1 |
| pJVED/DP428 | 0.7 | 0.06 | 18 | 300 |

| Construct | % Recovery | | RLU/10³ extracellular bacteria | RLU/10³ intracellular bacteria | | Induction | |
|---|---|---|---|---|---|---|---|
| | C57BL/6 | Balb/C | | C57BL/6 | Balb/C | C57BL/6 | Balb/C |
| pJVED/blaF* | 7 | 1.1 | 662 | 250 | 911 | 0.4 | 1.4 |
| pJVED/hsp18 | 6.7 | 1.7 | 164 | 261 | 325 | 1.6 | 2 |
| pJVED/DP428 | 1.6 | 2.1 | 0.08 | 1.25 | 3.3 | 15.6 | 41 |

TABLE 2

| Construct | % Recovery | RLU/10³ extracellular bacteria | RLU/10³ intracellular bacteria | Induction |
|---|---|---|---|---|
| pJVED/blaF* | 22 | 1477 | 367 | 0.25 |
| pJVED/hsp18 | 7 | 0.26 | 6.8 | 26 |
| PJVED/DP428 | 21 | 0.14 | 4 | 28 |

The nucleotide fragment encoding the N-terminal region of the polypeptide DP428 having the sequence SEQ ID NO: 543 is contained in the plasmid deposited at the CNCM under the No. I-1818.

The entire sequence encoding the polypeptide DP428 was obtained as detailed below.

A probe was obtained by PCR with the aid of oligonucleotides having the sequence SEQ ID NO: 528 and SEQ ID NO: 529. This probe was labeled by random extension in the presence of [$^{32}$P]dCTP. Hybridization of the genomic DNA of *M. tuberculosis* strain Mt103 previously digested with the endonuclease Sca1 was carried out with the aid of said probe. The results of the hybridization revealed that a DNA fragment of about 1.7 kb was labeled. Because an Sca1 site exists, extending from the nucleotide nt 984 to the nucleotide nt 989 of the sequence SEQ ID NO: 1, that is to say on the 5' side of the sequence used as probe, the end of the coding sequence is necessarily present in the fragment detected by hybridization.

The genomic DNA of the *M. tuberculosis* Mt 103 strain, after digestion with Sca1, was subjected to migration on agarose gel. The fragments of between 1.6 and 1.8 kb in size were cloned into the vector pSL1180 (Pharmacia) previously cleaved with Sca1 and dephosphorylated. After transformation of *E. coli* with the resulting recombinant vectors, the colonies obtained were screened with the aid of the probe. The screening made it possible to isolate six colonies hybridizing with this probe.

The inserts contained in the plasmids of the previously selected recombinant clones were sequenced and then the sequences aligned so as to determine the entire sequence encoding DP428, more specifically SEQ ID NO: 35.

A pair of primers were synthesized in order to amplify, starting with the genomic DNA of *M. tuberculosis*, strain Mt 103, the entire sequence encoding the polypeptide DP428. The amplicon obtained was cloned into an expression vector.

Pairs of primers appropriate for the amplification and the cloning of the sequence encoding the polypeptide DP428 can be easily produced by persons skilled in the art, on the basis of the nucleotide sequences SEQ ID NO: 1 and SEQ ID NO: 35.

A specific pair of primers according to the invention is the following pair of primers, which is capable of amplifying the DNA encoding the polypeptide DP428 lacking its signal sequence:

forward primer (SEQ ID NO: 917), comprising the sequence going from the nucleotide at position nt 531 to the nucleotide nt 554 of the sequence SEQ ID NO: 35:

5'-AGTGCAT <u>GCTGCTGGCCGAACCATCAGCGAC</u>-3' backward primer (SEQ ID NO: 918), comprising the sequence complementary to the forward sequence of the nucleotide at position nt 855 to the nucleotide at position nt 835 of the sequence SEQ ID NO: 35:

5'-CAGCCAGATCT <u>GCGGGCGCCCTGCACCGCCTG</u>-3', in which the portion underlined represents the sequences hybridizing specifically with the sequence SEQ ID NO: 35 and the 5' ends correspond to restriction sites for the cloning of the resulting amplicon into a cloning and/or expression vector.

A specific vector used for the expression of the polypeptide DP428 is the vector pQE70 marketed by the company Qiagen.

Example 3

The complete sequence of the DP428 gene and its flanking regions.

A probe of the coding region of DP428 was obtained by PCR and used to hybridize the genomic DNA of various mycobacterial species. According to the results of FIG. 3, the gene is present only in mycobacteria of the *M. tuberculosis* complex.

Analysis of the sequence suggests that DP428 could be part of an operon. The coding sequence and the flanking regions exhibit no homology with known sequences deposited in databanks.

Based on the coding sequence, the gene encodes a 10 kDa protein with a signal peptide, a hydrophobic C-terminal end which ends with two arginines and is preceded by an LPISG (SEQ ID NO: 934) motif similar to the known LPXTG (SEQ ID NO: 935) motif. These two arginines could correspond to a retention signal and the protein DP428 could be attached via this motif to peptidoglycans as has already been described in other Gram+ bacteria (Navarre et al., 1994 and 1996).

The mechanism for survival and intracellular growth of mycobacteria is complex and the intimate relationships between the bacteria and the host cell remain unexplained. Whatever the mechanism, the growth and the intracellular survival of mycobacteria depend on factors produced by the bacteria produced by the bacterium and capable of modulating the response of the host. These factors may be molecules which are exposed at the cell surface, such as LAM or cell surface-associated proteins, or actively secreted molecules.

On the other hand, intracellularly, the bacteria themselves have to confront a hostile environment. They appear to respond to this by means similar to those used under stress conditions, by inducing heat shock proteins (Dellagostin et al., 1995), but also by the induction or the repression of various proteins (Lee et al., 1995). Using a methodology derived from PCR, Plum and Clark-curtiss (Plum et al., 1994) have shown that an M. avium gene included in a 3 kb DNA fragment is induced after phagocytosis by human macrophages. This gene encodes an exported protein comprising a leader sequence but exhibiting no significant homology with the sequences proposed by databanks. The induction, during the intracellular growth phase, of a low-molecular-weight heat shock protein derived from M. leprae has also been demonstrated (Dellagostin et al., 1995). In another study, the bacterial proteins from M. tuberculosis were metabolically labeled during the intracellular growth phase or under stress conditions and separated by two-dimensional gel electrophoresis: 16 M. tuberculosis proteins were induced and 28 were repressed. The same proteins are involved during stress caused by a low pH, a heat shock, $H_2O_2$, or during phagocytosis by human monocytes of the THP1 line. Whatever the case, the behavior of the induced and repressed proteins was unique under each condition (Lee et al., 1995). Taken together, these results indicate that a subtle molecular dialogue is installed between the bacteria and their host cells. This dialogue probably depends on the fate of the intracellular organism.

In this context, the induction of the expression of DP428 could be of major importance, indicating an important role for this protein in intracellular survival and growth.

The method used in these experiments to evaluate the intracellular expression of the genes (cf. Jacobs et al., 1993, for the method for determining the expression of firefly luciferase, and Lim et al., 1995, for the method for determining the expression of the PhoA gene) has the advantage of being simple compared with the other techniques such as the technique described by Mahan et al. (Mahan et al., 1993) adapted to mycobacteria and proposed by Bange et al., (Bange et al., 1996) or the subtractive method based on PCR described by Plum and Clark-Curtiss (Plum et al., 1994). Variability undoubtedly exists as shown by comparing the various experiments. Although causing the induction or the repression is sufficient, it is now possible to evaluate it, thus providing an additional tool for the physiological studies of the exported proteins identified by fusion with phoA.

Example 4

Search for modulation of the activity of the promoters during the intramacrophage phases.

Mouse bone marrow macrophages are prepared as described by Lang and Antoine (Lang et al., 1991). Recombinant M. smegmatis bacteria, whose luciferase activity per $10^3$ bacteria has been determined as above, are incubated at 37° C. under a humid atmosphere enriched with 5% $CO_2$, for 4 hours in the presence of these macrophages such that they are phagocytosed. After rinsing in order to remove the remaining extracellular bacteria, amikacin (100 µg/ml) is added to the culture medium for two hours. After another rinsing, the medium is replaced with an antibiotic-free culture medium (DMEM enriched with 10% calf serum and 2 mM glutamine). After overnight incubation as above, the macrophages are lysed at low temperature (4° C.) with the aid of a lysis buffer (cee lysis buffer, Promega), and the luciferase activity per $10^3$ bacteria is determined. The ratio of the activities at placing in culture and after one night gives the coefficient of induction.

Example 5

Isolation of a series of sequences by sequencing directly using colonies.

A series of sequences allowing the expression and export of phoA were isolated from the DNA of M. tuberculosis or of M. bovis BCG. Among this group of sequences, two of them were further studied, the entire genes corresponding to the inserts were cloned, sequenced and antibodies against the product of these genes served to show by electron microscopy that these genes encoded antigens found at the surface of the tubercle bacilli. One of these genes, erp, encoding a consensus export signal sequence, the other, des, possessed no characteristic of a gene encoding an exported protein, based on the sequence. Another gene, DP428, was sequenced before the sequence of the M. tuberculosis genome became available. It contains a sequence resembling the consensus sequence for attachment to peptidoglycan, which suggests that it is also an antigen which is probably found at the surface of the tubercle bacilli. The study of the three genes, erp, des, and that encoding DP428, shows that the phoA system which we have developed in mycobacteria makes it possible to pick out genes encoding exported proteins with no determinant which can be picked out by studies in silico. This is particularly true for the polypeptides which do not possess a consensus signal sequence (des) or no similarity with proteins having a known function (erp and DP428).

A number of inserts were identified and sequenced before knowing the genome of M. tuberculosis or of others below. These sequences may be considered as primers which make it possible to search for genes encoding exported proteins. To date, a series of primers have been sequenced and the entire corresponding genes have been either sequenced or identified based on the published sequence of the genome. To take into account sequencing errors which are always possible, the regions upstream or downstream of some primers were considered as being capable of forming part of sequences encoding exported proteins. In some cases, similarities with genes encoding exported proteins or sequences characteristic of export signals or topological characteristics of membrane proteins were detected.

Primer sequences are found to correspond to genes belonging to families of genes possessing more than 50% similarity. It is thus possible to indicate that the other genes detected by similarity with a primer encode exported proteins. This is the case for the sequence SEQ ID NO: 154 and SEQ ID NO: 156 which possess more than 77% similarity with SEQ ID NOS: 137 & 143.

The sequences which may encode exported proteins are the following: SEQ ID NOS: 1, 8, 14, 25, 31, 33, 137, 139, 141, 143, 145, 148, 150, 152, 154, 156, 158, 160, 162, 225, 228, 238, 246, 250, 255, 258, 260, 41, 46, 52, 165, 169, 177, 407, 410, 412, 419, 421, 426, 429, 431, 433, 437, 441, 447, 452, 456, 459, 461, 110, 113, 119, 353, 357, 359, 489, 495, 497, 501, 505, 510, 516, 519, 522, 651, 653, 657, 660, 662, 759, 761, 764, 767, 769, 811, 813, 817, 821, 823, 887, 895, 901, 907, and 909.

Genes identified based on the primers from the sequence of the genome have no characteristic (based on the sequence) of the exported proteins. They are the following sequences: SEQ ID NOS: 57-61, 63, 65-66, 68, 70-71, 73, 75, 77, 79-80, 82-83, 85, 87, 531-533, 535-536, 538-542, 185-188, 190-194, 196-199, 201, 203-205, 207-208, 210, 212, 214-216, 218-219, 221-224, 263-267, 269-271, 275-277, 279, 281, 283, 285, 287, 289, 291-296, 298-309, 311-316, 123-127, 129-132, 134-136, 318-320, 322, 324, 326, 328-330, 332, 334, 336, 338, 340-345, 348-352, 362-363, 365-367, 369, 370, 372-373, 375-379, 381-382, 384, 386, 388, 390-392, 394, 396, 398, 400-402, 404, 406, 464-468, 470-471, 473, 475, 477-481, 483-484, 486, 488, 547-549, 551, 553, 555, 557, 559-563, 565-568, 570, 572, 574-575, 577-579, 581-583, 585, 587, 589, 591-593, 595, 597, 599, 601-603, 605-607, 609, 611, 613, 615, 617, 619, 621, 623, 625, 627-628, 630, 632, 634, 636-639, 641-646, 648, 650, 665, 931-933, 667-668, 670-673, 675, 677, 679-682, 684-685, 687-690, 692, 694, 696, 698-701, 703-716, 718-727, 729-732, 734-735, 737, 738, 740, 742, 744-745, 747-751, 753-754, 756, 758, 772-780, 781-783, 785-793, 795-804, 806, 808, 810, 826, 828-830, 832, 834, 836, 838, 840-841, 843, 845, 847, 849-863, 865-877, 879-882, 884, and 886.

Based on the sequence of other organisms such as *E. coli*, it is possible to search in the sequence of the *M. tuberculosis* genome for genes possessing similarities with proteins known to be exported in other organisms although not possessing an export signal sequence. In this case, fusion with phoA is an advantageous protocol for determining if these *M. tuberculosis* sequences encode exported proteins although possessing no consensus signal sequence. It has indeed been possible to clone SEQ ID NOS: 848, 864, 878, 883, and 885, sequences similar to an *E. coli* gene of the htrA family. A fusion of SEQ ID NOS: 848, 864, 878, 883, and 885 with phoA leads to the expression and the export of phoA. *M. smegmatis* colonies harboring SEQ ID NOS: 848, 864, 878, 883, and 885 phoA fusion on a plasmid pJVED are blue.

SEQ ID NOS: 849-863, 865-877, 879, 880-882, 884, and 886 are therefore considered exported proteins.

The phoA method is therefore useful for detecting, based on the *M. tuberculosis* sequence, genes encoding exported proteins without them encoding sequences which are characteristic of the exported proteins.

Even if a sequence possesses determinants of exported proteins, this does not demonstrate a functional export. The phoA system makes it possible to show that the gene suspected really encodes an exported protein. Thus, it was checked that the sequences SEQ ID NOS: 887, 895, 901, 907 and 909 indeed possessed export signals.

TABLE 3

| SEQ ID No. | Reference of the corresponding sequence predicted by Cole et al. | | Annotation |
|---|---|---|---|
| SEQ ID NOS: 2-7, 9-13, 15-24, 26-30, 32, 34 | Rv 0203 | * | Sequence hydrophobic at the N-terminus |
| SEQ ID NOS: 57-61, 63, 65-66, 68, 70-71, 73, 75, 77, 79-80, 82-83, 85, 87, 531-533, 535-536, 538-542 | Rv 2050 | | No prediction |
| SEQ ID NOS: 138, 272-273, 140, 142, 144, 146-147, 149, 151, 153, 155, 157, 159, 161, 163-164 | Rv 2563 | * | Membrane protein |
| SEQ ID NOS: 155, 157 | Rv 0072 | * | Possible transmembrane transport protein of the ABC type |
| SEQ ID NOS: 185-188, 190-194, 196-199, 201, 203-205, 207-208, 210, 212 | Rv 0546c | ML | Protein S-D Lactoyl Glutathione-methyl glyoxal lyase |
| SEQ ID NOS: 214-216, 218, 219, 221-224 | no prediction | | not found in *M. tuberculosis* H37rv |
| SEQ ID NOS: 226-227, 923-925, 229-237, 239-245, 247-249, 251-254, 256-257, 259, 261, 42-45, 47-51, 53-55, 166-168, 170-176, 178-183 | Rv 1984c | * | probable precursor cutinase with an N-terminal signal sequence |
| SEQ ID NOS: 263-267, 269-271, 275-277, 279, 281, 283, 285, 287, 289, 291-296, 298-309, 311-316, 123-127, 129-132, 134-136 | no prediction | | no prediction |
| SEQ ID NOS: 318-320, 322, 324, 326, 328-330, 332, 334, 336, 338, 340-345, 348-352 | with reading frame shift, could be in phase with Rv 2530c | | no prediction |
| SEQ ID NOS: 362-363, 365-367, 369-370, 372-373, 375-379, 381-382, 384, 386 | Rv 1303 | ML | no prediction |
| SEQ ID NOS: 388, 390-392, 394, 396, 398, 400-402, 404, 406 | Rv 0199 | ML | no prediction |
| SEQ ID NOS: 408-409, 411, 413-418, 420, 422-425, 427-428, 430, 432 | Rv 0418 | * | site for attachment of prokaryotic membrane lipoprotein, similarity with N-acetyl puromycin acetyl hydrolase |
| SEQ ID NOS: 434-436, 438-440, 442-446, | Rv 3576 | * | contains a site for attachment of prokaryotic membrane lipoprotein, |

TABLE 3-continued

| SEQ ID No. | Reference of the corresponding sequence predicted by Cole et al. | | Annotation |
|---|---|---|---|
| 448-451, 453-455, 457-458, 460, 462, 111-112, 114-118, 120-121 | | | similarity with a serine/threonine protein kinase |
| SEQ ID NOS: 464-468, 470-471, 473, 475, 477-481, 483-484, 486, 488 | Rv 3365c | ML | similarity with a zinc metallopeptidase |
| SEQ ID NOS: 547-549, 551, 553, 555 | not predicted | | no prediction |
| SEQ ID NOS: 557, 559-563, 565-568, 570, 572 | Rv 0822c | ML | Existence of a consensus region with the drac family |
| SEQ ID NOS: 574-575, 577-579, 581-583, 585, 587 | Rv 1044 | | no prediction |
| SEQ ID NOS: 589, 591-593, 595, 597 | not predicted | | no prediction |
| SEQ ID NOS: 599, 601-603, 605-607, 609, 611 | Rv 2169c | | no prediction |
| SEQ ID NOS: 613, 615, 617, 619, 621 | Rv 3909 | ML | no prediction |
| SEQ ID NOS: 623, 625, 627-628, 630, 632 | Rv 2753c | | similarity with dihydropricolinate synthases |
| SEQ ID NOS: 634, 636-639, 641-646, 648, 650, | Rv 0175 | | no prediction |
| SEQ ID NOS: 652, 654-656, 658-659, 661, 663 | Rv 3006 | * ML | prediction of lipoprotein signal sequence |
| SEQ ID NOS: 665, 931-933, 667-668, 670-673, 675, 677 | Rv 0549c | | no prediction |
| SEQ ID NOS: 679-682, 684-685, 687-690, 692, 694, 696, 698-701, 703-716, 718-727 | Rv 2975c being capable of being in phase with Rv 2974c | | similarity with substilis protein |
| SEQ ID NOS: 729-732, 734 735, 737-738, 740, 742 | Rv 2622 | | similarity with a methyl transferase |
| SEQ ID NOS: 744-745, 747-751, 753-754, 756, 758 | Rv 3278c | ML | no prediction |
| SEQ ID NOS: 760, 762-763, 765-766, 768, 770 | Rv 0309 | * | no prediction |
| SEQ ID NOS: 772-783, 785-793, 795-804, 806, 808, 810 | Rv 2169c | ML | no prediction |
| SEQ ID NOS: 812, 814-816, 818-820, 822, 824 | Rv 1411c | * | probable lipoprotein with an N-terminal signal sequence |
| SEQ ID NOS: 826, 828-830, 832, 834, 836 | Rv 1714 | | similarity with a gluconate 3-dehydrogenase |
| SEQ ID NOS: 838, 840-841, 843, 845, 847, | Rv 0331 | | similarity with a sulfide dehydrogenase and a sulfide quinone reductase |
| SEQ ID NOS: 849-863, 865-877, 879-882, 884, 886 | Rv 0983 | ML | similarity with a serine protease HtrA |
| SEQ ID NOS: 89, 91, 93-95, 97, 99, 101-103, 105, 107, 109 | | | |
| SEQ ID NOS: 354-356, 358, 360, 926-930 | Rv 3810 | * ML | Surface protein (Berthelet et al., 1995) |
| SEQ ID NOS: 490-494, 496, 498-500, 502-504, 506-509, 511-515, 517-518, 520-521, 523-527 | Rv 3763 | * | Contains a site for attachment of eukaryotic membrane lipoprotein |
| SEQ ID NOS: 888-894, 896-900, 902-906, 908, 910 | Rv 0125 | * | Active site of serine proteases Possible N-terminal signal sequence |

Legend to Table 3:

Correspondence between the sequences according to the invention and the sequences predicted by Cole et al., 1998, Nature, 393, 537-544.

*: Prediction that the protein encoded by the sequence is exported.

ML: Prediction of similarity with *M. leprae*.

Example 6

Characteristics and production of the protein M1C25.

The N-terminal end of the protein M1C25 was detected by the PhoA system as allowing the export of the fusion protein, necessary for the production of its phosphatase activity.

The DNA sequence encoding the N-terminal end of the protein M1C25 is contained in the sequences SEQ ID NOS: 433, 437, 441, 447, 452, 456, 459, 461 of the present patent application.

From this primer sequence, the complete gene encoding the protein M1C25 was sought in the *M. tuberculosis* genome (Wellcome Trust Foundation, Sanger site).

The Sanger center attributed to M1C25 the names:
Rv 3576,
MTCY06G11.23,
pknM

Sequence SEQ ID NO: 544 of the Complete M1C25 Gene (714 Bases): cf. FIG. 29

This gene encodes a protein of 237 AA, having a molecular mass of 25 kDa. This protein is listed in the libraries under the names:
PID:e306716,
SPTREMBL:P96858

Sequnce SEQ ID NO: 545 of the Protein M1C25 (235 Amino Acids): cf. FIG. 30

M1C25 contains a site for attachment to the lipid portion of the prokaryotic membrane lipoproteins (PS00013 Prokaryotic membrane lipoprotein lipid attachment site:
CTGGTCGGTG CGTGCATGCT CGCAGCCGGA TGC)(SEQ ID NO: 919).

The function of M1C25 is not clear but it most probably possesses a "serine/threonine protein kinase" activity. Similarities should be noted with the C-terminal moiety of K08G_MYCTU Q11053 Rv1266c (MTCY50.16). Similarities are also found with KY28_MYCTU.

A gene potentially encoding a regulatory protein (PID: e306715, SPTREMBL:P96857, Rv3575c, (MTCY06G11.22c)) is found in 5' of the gene encoding M1C25.

The hydrophobicity profile (Kyte and Doolitle) of M1C25 is represented in FIG. 56.

A site of cleavage of the signal sequence is predicted (SignalP V1.1; World Wide Web Prediction Server, Center for Biological Sequence Analysis) between amino acids 31 and 32: AVA-AD. This cleavage site is behind a conventional "AXA" motif. This prediction is compatible with the hydrophobicity profile. In this potential signal sequence, it is observed that the sequence of the three amino acids LAA is repeated three times.

Cloning of the M1C25 gene for the production of the protein which it encodes:

A pair of primers were synthesized in order to amplify, using the genomic DNA of *M. tuberculosis*, strain H37Rv, the entire sequence encoding the polypeptide M1C25. The amplicon obtained was cloned into an expression vector.

Pairs of primers appropriate for the amplification and the cloning of the sequence encoding M1C25 were synthesized:

forward primer:(SEQ ID NO: 920)

5'-ATAATACCATGGGCAAGCAGCTAGCCGCGC-3' backward primer:(SEQ ID NO: 921)

5'-ATTTATAGATCT CTGCTTAGCAACCTTGGCCGCG-3'

The underlined portion represents the sequences specifically hybridizing with the M1C25 sequence and the 5' ends correspond to restriction sites for the cloning of the resulting amplicon into a cloning and/or expression vector.

A specific vector used for the expression of the polypeptide M1C25 is the vector pQE60 marketed by the company Qiagen, following the protocol and the recommendations proposed by this brand.

The cells used for the cloning are bacteria: *E. coli* XL1-Blue (resistant to tetracycline).

The cells used for the expression are bacteria: *E. coli* M15 (resistant to kanamycin) containing the plasmid pRep4 (M15 pRep4).

The production of the protein MYC25 is illustrated by FIGS. 57 A and B (bacterial extracts from the *E. coli* M15 strain containing the plasmid pM1C25). The bacterial cultures and the extracts are prepared according to Sambrook et al. (1989). Analysis of the bacterial extracts is carried out according to the Quiagen instructions (1997).

Bibliographic References

AIDS therapies, 1993, in Mycobacterial infections, ISBN 0-9631698-1-5, pp. 1-11.

Altschul, S. F. et al., 1990, J. Mol. Biol., 215: 403-410.

Andersen, P. et al., 1991, Infect. Immun., 59: 1905-1910.

Andersen, P. et al., 1995, J. Immunol., 154: 3359-3372.

Bange, F. C. et al., A. M. Brown, and W. R. Jacobs JR., 1996, Leucine auxotrophy restricts growth of *Mycobacterium bovis* BCG in macrophages. Infect. Immun., 64:1794-1799.

Barany, F., 1911, Proc. Natl. Acad. Sci. USA, 88: 189-193.

Bates, J. 1979, Chest. 76(Suppl.):757-763.

Bates, J. et al., 1986. Am. Rev. Respir. Dis. 134: 415-417.

Berthet, F. X., J. Rauzier, E. M. Lim, W. Philipp, B. Gicquel, and D. Portnoi, 1995, Characterization of the *M. tuberculosis* erp gene encoding a potential cell surface protein with repetitive structures. Microbiology. In press.

Borremans, M. et al., 1989, Biochemistry, 7: 3123-3130.

Bouvet, E. 1994, Rev. Fr. Lab. 273: 53-56.

Brockman, R. W. and Heppel L. A., 1968, On the localization of alkaline phosphatase and cyclic phosphodiesterase in *Escherichia coli,* Biochemistry, 7: 2554-2561.

Burg, J. L. et al., 1996, Mol. and Cell. Probes, 10: 257-271.

Chevrier, D. et al., 1993, Mol. and Cell. Probes, 7: 187-197.

Chu, B. C. F. et al., 1986, Nucleic Acids Res., 14: 5591-5603.

Clemens, D. L., 1996, Characterization of the *Mycobacterium tuberculosis* phagosome, Trends Microbiol., 4: 113-118.

Clemens, D. L. and Horwitz M. A., 1995, Characterization of the *Mycobacterium tuberculosis* phagosome and evidence that phagosomal maturation is inhibited, J. Exp. Med., 181: 257-270.

Colignon J. E., 1996, Immumologic studies in humans. Measurement of proliferative responses of culturered lymphocytes. Current Protocols in Immunology, NIH, 2, Section II.

Daniel, T. M. et al. 1987, Am. Rev. Respir. Dis., 135: 1137-1151).

Dellagostin, O. A., Esposito G., Eales L.-J., Dale J. W. and McFadden J. J., 1995, Activity of mycobacterial promoters during intracellular and extracellular growth. Microbiol., 141: 2123-2130.

Drake, T. A. et al. 1987. J. Clin. Microbiol. 25: 1442-1445.

Dramsi et al., 1997, Infection and Immunity, 65, 5: 1615-1625.

Duck, P. et al., 1990, Biotechniques, 9: 142-147.

Erlich, H. A. 1989. In PCR Technology. Principles and Applications for DNA Amplification. New York: Stockton Press.

Felgner et al., 1987, Proc. Natl. Acad. Sci., 84: 7413.

Fraley et al., 1980, J. Biol. Chem., 255: 10431.

Gaillard, J. L., Berche P., Frehel C., Gouin E. and Cossart P., 1991, Entry of *L. monocytogenes* into cells is mediated by internalin, a repeat protein reminiscent of surface antigens from Gram-positive cocci, Cell., 65: 1127-1141.

Garbe, T., Harris D., Vordermeir M., Lathigra R., lvanyi J. and Young D., 1993, Expression of the *Mycobacterium tuberculosis* 19-kilodalton antigen in *Mycobacterium smegmastis:* immunological analysis and evidence of glycosylation. Infect. Immun., 61: 260-267.

Guateli, J. C. et al., 1990, Proc. Natl. Acad. Sci. USA, 87: 1874-1878.

Harboe et al., 1996, Infect. Immun., 64: 16-22.

Herrmann, J. L., O'Gaora P., Gallagher A., Thole J. E. R. and Young D. B., 1996, Bacterial glycoproteins: a link between glycosylation and proteolytic cleavage of a 19 kDa antigen from *Mycobacterium tuberculosis,* EMBO J. 15: 3547-3554.

Houbenweyl, 1974, in Meuthode der Organischen Chemie, E. Wunsch Ed., Volume 15-I et 15-II, Thieme, Stuttgart.

Huygen, K. et al., 1996, Nature Medicine, 2(8): 893-898.

Innis, M. A. et al., 1990. in PCR Protocols. A Guide to Methods and Applications. San Diego: Academic Press.

Isberg, R. R., Voorhis D. L. and Falkow S., 1987, Identification of invasin: a protein that allows enteric bacteria to penetrate cultured mammalian cells, Cell, 50: 769-778.

Jacobs, W. R. et al., 1991. Construction of mycobacterial genomic libraries in shuttle cosmids. Genetic Systems for Mycobacteria, Methods in Enzymology, 204: 537-555.

Jacobs, W. R. et al., 1993, Science, 260: 819-822.

Kaneda, et al., 1989, Science, 243:375.

Kiehn, T. E., et al. 1987. J. Clin. Microbiol. 25: 1551-1552.

Kievitis, T. et al., 1991, J. Virol. Methods, 35: 273-286.

Kohler, G. et al., 1975, Nature, 256(5517):495-497.

Kwoh, D. Y. et al., 1989, Proc. Natl. Acad. Sci. USA, 86: 1173-1177.

Landegren, U. et al., 1988, Science, 241: 1077-1080.

Lang, T. and Antoine J.-C., 1991, Localization of MHC class II molecules in murine bone marrow-derived macrophages. Immunology, 72: 199-205.

Lee, B. Y and Horwitz M. A., 1995, Identification of macrophage and stress-induced proteins of *Mycobacterium tuberculosis*, J. Clin. Invest., 96: 245-249.

Lim, E. M., Rauzier J., Timm J., Torrea G., Murray A., Gicquel B. and Portnoï D., 1995, Identification of *Mycobacterium tuberculosis* DNA sequences encoding exported proteins, using phoA gene fusions, J. Bacteriol., 177: 59-65.

Lizardi, P. M. et al., 1988, Bio/technology, 6: 1197-1202.

Mahan, M. J. et al., 1993. Selection of bacterial virulence genes that are specifically induced in host tissues, Science, 259: 686-688.

Manoil L., Mekolanos J. J. and Beckwith J., J. Bacteriol., 1990, 172: 515-518.

Matthew, J. A. et al., 1988, Anal. Biochem., 169: 1-25.

Merrifield, R. D., 1966, J. Am. Chem. Soc., 88(21): 5051-5052.

Midoux, P. et al., 1993, Nucleic Acids Research, 21: 871-878.

Miele, E. A. et al., 1983, J. Mol. Biol., 171: 281-295.

Minton, N. P., 1984, Gene, 31: 269-273.

Montgomery et al., 1993, DNA Cell Biol., 12: 777-783.

Navarre, W. W. et al., 1994, Molecular Microbiologie, 14(1): 115-121.

Navarre, W. W. et al., 1996, J. of Bacteriology, 178, 2: 441-446.

Pagano et al., 1967, J. Virol., 1: 891.

Pastore, 1994, Circulation, 90:I-517.

Patel, et al. 1990, J. Clin. Microbiol. 28: 513-518.

Prentki, B. and Krish H. M., 1984, Gene 29: 303-313.

Pettersson R., Nordfelth J., Dubinina E., Bergman T., Gustafsson M., Magnusson K. E. and Wolf-Watz H., 1996, Modulation of virulence factor expression by pathogen target cell contact. Science, 273: 1231-1233.

Plum, G. and Clark-Curtiss J. E., 1994, Induction of Mycobacterium avium gene expression following phagocytosis by human macrophages. Infect. Immun., 62: 476-483.

Roberts, M. C., et al., 1987, J. Clin. Microbiol. 25:1239-1243.

Rolfs, A. et al., 1991, In PCR Topics. Usage of Polymerase Chain Reaction in Genetic and Infectious Disease. Berlin: Springer-Verlag.

Sambrook, J. et al. 1989, In Molecular Cloning: A Laboratory Manual. Cold Spring Harbor, N.Y.: Cold Spring Harbor Laboratory Press.

Sanchez-Pescador, R., 1988, J. Clin. Microbiol., 26(10): 1934-1938.

Schneewind, O. et al., 1995, Science, 268: 103-106.

Segev D., 1992, in Non-radioactive Labeling and Detection of Biomolecules. Kessler C. Springer Verlag, Berlin, New-York, 197-205.

Servant, P. and Mazodier P., 1995, Characterization of *Streptomyces albus* 18-kilodalton heat shock-responsive protein. J. Bacteriol., 177: 2998-3003.

Shiver, J. W., 1995, in Vaccines 1995, eds Chanock, R. M. Brown, F. Ginsberg, H. S. & Norrby, E.), pp. 95-98, Cold Spring Harbor Laboratory Press, Cold Spring Harbor, N.Y.

Sorensen et al., 1995, Infect. Immun., 63: 1710-1717.

Stone, B. B. et al., 1996, Mol. and Cell. Probes, 10: 359-370.

Stover, C. K., Bansal G. P., Hanson M. S., Burlein S. R., Palaszynski S. R., Young J. F., Koenig S., Young D. B., Sadziene A. and Barbour A. G., 1993, Protective immunity elecited by recombinant Bacille Calmette-Guérin (BCG) expressing outer surface protien A (OspA) lipoprotein: a candidate Lyme disease vaccine. J. Exp. Med., 178: 197-209.

Sturgill-Koszycki, S., Schlesinger P. H., Chakroborty P., Haddix P. L., Collins H. L., Fok A. K., Allen R. D., Gluck S. L., Heuser J. and Russell D. G., 1994, Lack of acidification of *Mycobacterium* phagosomes by exclusion of the vesicular proton-ATPase. Science, 263: 678-681.

Tascon, R. E. et al., 1996, Nature Medicine, 2(8): 888-892.

Technique for assembling oligonucleotides, 1983, Proc. Natl. Acad. Sci. USA, 80: 7461-7465.

Technique for beta-cyanethylphosphoramidites, 1986, Bioorganic Chem., 4: 274-325.

Thierry, D. et al., 1990, Nucl. Acid Res., 18: 188.

Timm, J., Perilli M. G., Duez C., Trias J., Orefici G., Fattorini L., Amicosante G., Oratore A., Boris B., Frere J. M., Pugsley A. P. and Gicquel B., 1994, Transcription and expression analysis, using lacZ and phoA gene fusions, of *Mycobacterium fortuitum* B-lactamase genes cloned from a natural isolate and a high-level B-lactamase producer. Mol. Microbiol., 12: 491-504.

Tuberculosis Prevention Trial, 1980, Mendis, Trial of BCG vaccines in South India for Tuberculosis Infection, Indian J. of Med. Res., 1972 (Suppl.): 1-74.

Urdea, M. S. et al., 1991, Nucleic Acids Symp. Ser., 24: 197-200.

Urdea, M. S., 1988, Nucleic Acids Research, 11: 4937-4957.

Verbon, A., Hartskeerl R. A., Schuitema A., Kolk A. H., Young D. B. and Lathigra R., 1992, The 14,000-molecular-weight antigen of *Mycobacterium tuberculosis* is related to the alpha-crystallin family of low-molecular-weight heat shock proteins. J Bacteriol., 174: 1352-1359.

Walker, G. T. et al., 1992, Nucleic Acids Res., 20: 1691-1696.

Walker, G. T. et al., 1992, Proc. Natl. Acad. Sci. USA, 89: 392-396.

Wiker, H. G. et al., 1992, Microbiol. Rev., 56: 648-661.

Yamaguchi, R. et al., 1989, Infect. Immun., 57: 283-288.

Xu, S., Cooper, A., Sturgill-Koszycki, S., van Heyningen, T., Chatterjee, D., Orme, I., Allen, P. and Russel, D. G., 1994, Intracellular trafficking in *Mycobacterium tuberculosis* and *Mycobacterium avium*-infected macrophages, J. Immunol., 153: 2568-2578.

Young, D. B. et al., 1992, Mol. Microbiol., 6: 133-145.

Yuen, L. K. W. et al., 1993, J. Clin. Microbiol., 31: 1615-1618.

SEQUENCE LISTING (935 sequences)

SEQ ID NO: 1 - DNA, 1243 bp, Mycobacterium tuberculosis
  CDS (21)..(38)
  CDS (124)..(453)
  CDS (473)..(481)
  CDS (573)..(671)
  CDS (719)..(928)
  CDS (942)..(1241)
ggatcccagggaacgtgaccatggtcgtagggatgacttgacagtttcaacggggtgcgaccaccgttgcgctcagaaggcatacgttggtggaacacgtcggaaagctgggaggtgaatctgatggctggcgaccaagagctggaactgcggttcgacgttcctctttacacgcttgccgaggcatcgcggtacctggtggttccccgcgccaccctggctacgtgggctgacggctacgagcgtcggccggccaacgcaccggcggtccaggggcaaccgatcgcctttgacgcctattcggtcgcgcagctttttggcgacgtcactggtgcccgcgttgcgggcgtccagccgcagcgacaccacatacggccggtccggttgcgggggccgttgggtggggttgggtgcctccgtcaccccaggcagttcgctggctatttgtcgcagtagcgcgacggcattgtcgatgtcttggtagctagcatccggtcggggggccgctaccagcgccagcgccggggctccccggtccgggtagtgcgcgtcgagttggtcgtggaccagcaatgactgcgacccggcgacttcgaaaccgccaccggttagattccccgactgcgtcatcgccaggtaaaccgccggcactaacgccagcaaccaacccgtgaagaccaaccaacggcacctgcgcaggttgcggctcaaccgcatcatgaactgctggatttcggactccccgtactctcgcgcagtgcgtgcccgcgagcctaccgaagatcgcgtgcatgcgttcggcgtggaccgcacagcacctggagttggcggcgccgagggccgagatggcaggatgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatcc

SEQ ID NO: 2 - protein, 322 aa, Mycobacterium tuberculosis
MVVGMTMAGDQELELRFDVPLYTLAEASRYLVVPRATLATWADGYERRPANAPAVQGQPIAFDAYSVAQLFGDVTGARVAGVQPQRHHIRPVRLRGPLGGVGCLRHPRQFAGYLSQMSWMTATRRLRNRHRLDSPTASSPGKPPALTPATNPMNCWISDSPYSRAVRAREPTEDRVHAFGVDRTAPGVGGAEGRDGRMTDRRGRELPGRRTVANPSQTRRKPMKTGTATTRRRLLAVLIALALPGAAVALLAEPSATGASDPCAASEVARTVGSVAKSMGDYLDSHPETNQVMTAVLQQQVGPGSVASLKAHFEANPKVASD

SEQ ID NO: 3 - protein, 6 aa, Mycobacterium tuberculosis
MVVGMT

SEQ ID NO: 4 - protein, 110 aa, Mycobacterium tuberculosis
MAGDQELELRFDVPLYTLAEASRYLVVPRATLATWADGYERRPANAPAVQGQPIAFDAYSVAQLFGDVTGARVAGVQPQRHHIRPVRLRGPLGGVGCLRHPRQFAGYLSQ

SEQ ID NO: 5 - protein, 33 aa, Mycobacterium tuberculosis
MTATRRLRNRHRLDSPTASSPGKPPALTPATNP

SEQ ID NO: 6 - protein, 70 aa, Mycobacterium tuberculosis
MNCWISDSPYSRAVRAREPTEDRVHAFGVDRTAPGVGGAEGRDGRMTDRRGRELPGRRTVANPSQTRRKP

SEQ ID NO: 7 - protein, 100 aa, Mycobacterium tuberculosis
MKTGTATTRRRLLAVLIALALPGAAVALLAEPSATGASDPCAASEVARTVGSVAKSMGDYLDSHPETNQVMTAVLQQQVGPGSVASLKAHFEANPKVASD

SEQ ID NO: 8 - DNA, 961 bp, Mycobacterium tuberculosis
  CDS (1)..(9)
  CDS (13)..(204)
  CDS (208)..(390)
  CDS (394)..(438)
  CDS (442)..(573)
  CDS (577)..(960)
gatcgcctttgacgcctattcggtcgcgcagctttttggcgacgtcactggtgcccgcgttgcgggcgtccagccgcagcgacaccacatacggccggtccggttgcgggggccgttgggtggggttgggtgcctccgtcaccccaggcagttcgctggctatttgtcgcagtagcgcgacggcattgtcgatgtcttggtagctagcatccggtcggggggccgctaccagcgccagcgccggggctccccggtccgggtagtgcgcgtcgagttggtcgtggaccagcaatgactgcgacccggcgacttcgaaaccgccaccggttagattccccgactgcgtcatcgccaggtaaaccgccggcactaacgccagcaaccaacccgtgaagaccaaccaacggcacctgcgcaggttgcggctcaaccgcatcatgaactgctggatttcggactccccgtactctcgcgcagtgcgtgcccgcgagcctaccgaagatcgcgtgcatgcgttcggcgtggaccgcacagcacctggagttggcggcgccgagggccgagatggcaggatgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatc

SEQ ID NO: 9 - protein, 64 aa, Mycobacterium tuberculosis
RLFGRAAFWRRHWCPRCGRPAAATPHTAGPVAGAVGWGWVPPSPQAVRWLFVAVARRHCRCLGS

SEQ ID NO: 10 - protein, 61 aa, Mycobacterium tuberculosis
HPVGGPLPAPAPGLPGPGSARRVGRGPAMTATRRLRNRHRLDSPTASSPGKPPALTPATNP

SEQ ID NO: 11 - protein, 15 aa, Mycobacterium tuberculosis
RPTNGTCAGCGSTAS

SEQ ID NO: 12 - protein, 44 aa, Mycobacterium tuberculosis
TAGFRTPRTLAQCVPASLPKIACMRSAWTAQHLELAAPRAEMAG

SEQ ID NO: 13 - protein, 128 aa, Mycobacterium tuberculosis
RIVGGGNSQAAGPSQTRRKPVANRKESSMKTGTATTRRRLLAVLIALALPGAAVALLAEPSATGASDPCAASEVARTVGSVAKSMGDYLDSHPETNQVMTAVLQQQVGPGSVASLKAHFEANPKVASD

SEQ ID NO: 14 - DNA, 960 bp, Mycobacterium tuberculosis
  CDS (1)..(171)
  CDS (175)..(291)
  CDS (295)..(327)
  CDS (331)..(369)
  CDS (373)..(660)
  CDS (664)..(705)
  CDS (709)..(867)
  CDS (874)..(894)
  CDS (898)..(918)
  CDS (922)..(960)
atcgcctttgacgcctattcggtcgcgcagctttttggcgacgtcactggtgcccgcgttgcgggcgtccagccgcagcgacaccacatacggccggtccggttgcgggggccgttgggtggggttgggtgcctccgtcaccccaggcagttcgctggctatttgtcgcagtagcgcgacggcattgtcgatgtcttggtagctagcatccggtcggggggccgctaccagcgccagcgccggggctccccggtccgggtagtgcgcgtcgagttggtcgtggaccagcaatgactgcgacccggcgacttcgaaaccgccaccggttagattccccgactgcgtcatcgccaggtaaaccgccggcactaacgccagcaaccaacccgtgaagaccaaccaacggcacctgcgcaggttgcggctcaaccgcatcatgaactgctggatttcggactccccgtactctcgcgcagtgcgtgcccgcgagcctaccgaagatcgcgtgcatgcgttcggcgtggaccgcacagcacctggagttggcggcgccgagggccgagatggcaggatgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatc

SEQ ID NO: 15 - protein, 57 aa, Mycobacterium tuberculosis
IAFDAYSVAQLFGDVTGARVAGVQPQRHHIRPVRLRGPLGGVGCLRHPRQFAGYLSQ

SEQ ID NO: 16 - protein, 39 aa, Mycobacterium tuberculosis
RDGIVDVLVASIRSGGRYQRQRRGSPVRVVRVELVVDQQ

SEQ ID NO: 17 - protein, 11 aa, Mycobacterium tuberculosis
LRPGDFETATG

SEQ ID NO: 18 - protein, 13 aa, Mycobacterium tuberculosis
IPRLRHRQVNRRH

SEQ ID NO: 19 - protein, 96 aa, Mycobacterium tuberculosis
RQQPTREDQPTAPAQVAAQPHHELLDFGLPVLSRSACPRAYRRSRACVRRGPHSTWSWRRRGPRWQDDGSSGAGTPRPPDRRKPVANPSQTVRSHP

SEQ ID NO: 20 - protein, 14 aa, Mycobacterium tuberculosis
RQAPRRRGAGCWQY

SEQ ID NO: 21 - protein, 53 aa, Mycobacterium tuberculosis
SPSRCRGPPLRCWPNHQRPARRTRARPAKWRGRSVRSPSRWATTWIHTQRPTR

SEQ ID NO: 22 - protein, 7 aa, Mycobacterium tuberculosis
PRSCSSR

SEQ ID NO: 23 - protein, 7 aa, Mycobacterium tuberculosis
GRGRSHR

SEQ ID NO: 24 - protein, 13 aa, Mycobacterium tuberculosis
RPISRRIPRSHRI

SEQ ID NO: 25 - DNA, 959 bp, Mycobacterium tuberculosis
  CDS (1)..(198)
  CDS (202)..(258)
  CDS (262)..(354)
  CDS (358)..(645)
  CDS (649)..(957)
tcgcctttgacgcctattcggtcgcgcagctttttggcgacgtcactggtgcccgcgttgcgggcgtccagccgcagcgacaccacatacggccggtccggttgcgggggccgttgggtggggttgggtgcctccgtcaccccaggcagttcgctggctatttgtcgcagtagcgcgacggcattgtcgatgtcttggtagctagcatccggtcggggggccgctaccagcgccagcgccggggctccccggtccgggtagtgcgcgtcgagttggtcgtggaccagcaatgactgcgacccggcgacttcgaaaccgccaccggttagattccccgactgcgtcatcgccaggtaaaccgccggcactaacgccagcaaccaacccgtgaagaccaaccaacggcacctgcgcaggttgcggctcaaccgcatcatgaactgctggatttcggactccccgtactctcgcgcagtgcgtgcccgcgagcctaccgaagatcgcgtgcatgcgttcggcgtggaccgcacagcacctggagttggcggcgccgagggccgagatggcaggatgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatc

SEQ ID NO: 26 - protein, 66 aa, Mycobacterium tuberculosis
SPLTPIRSRSFLATSLVPALRASSRSDTTYGRSGCGGRWVGLGASVTPGSSLAICRSSATALSMSW

SEQ ID NO: 27 - protein, 19 aa, Mycobacterium tuberculosis
LASGRGAATSASAGAPRSG

SEQ ID NO: 28 - protein, 31 aa, Mycobacterium tuberculosis
CASSWSWTSNDCDPATSKPPPVRFPDCVIAR

SEQ ID NO: 29 - protein, 96 aa, Mycobacterium tuberculosis
TAGTNASNQPVKTNQRHLRRLRLNRIMNCWISDSPYSRAVRAREPTEDRVHAFGVDRTAPGVGGAEGRDGRMTDRRGRELPGRRTVANPSQTRRKP

SEQ ID NO: 30 - protein, 103 aa, Mycobacterium tuberculosis
GVIHEDRHRDDAAQAVGSTDRPRVAGGRRCAAGRTISDRRVGPVRGQRSGEDGRFGRQVDGRLPGFTPRDQPGDDRGLAAAGRAGVGRIAEGPFRGESQGRIG

SEQ ID NO: 31 - DNA, 411 bp, Mycobacterium tuberculosis
  CDS (1)..(408)
atgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatctgcacgcgctttcgcaaccgctgaccgatctttcgactcggtgctcgctgccgatcagcggcctgcaggcgatcggtttgatgcaggcggtgcagggcgcccgccggtag

SEQ ID NO: 32 - protein, 136 aa, Mycobacterium tuberculosis
MKTGTATTRRRLLAVLIALALPGAAVALLAEPSATGASDPCAASEVARTVGSVAKSMGDYLDSHPETNQVMTAVLQQQVGPGSVASLKAHFEANPKVASDLHALSQPLTDLSTRCSLPISGLQAIGLMQAVQGARR

SEQ ID NO: 33 - DNA, 498 bp, Mycobacterium tuberculosis
  CDS (4)..(495)
tgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatctgcacgcgctttcgcaaccgctgaccgatctttcgactcggtgctcgctgccgatcagcggcctgcaggcgatcggtttgatgcaggcggtgcagggcgcccgccggtag

SEQ ID NO: 34 - protein, 164 aa, Mycobacterium tuberculosis
RIVGGGNSQAAGPSQTRRKPVANRKESSMKTGTATTRRRLLAVLIALALPGAAVALLAEPSATGASDPCAASEVARTVGSVAKSMGDYLDSHPETNQVMTAVLQQQVGPGSVASLKAHFEANPKVASDLHALSQPLTDLSTRCSLPISGLQAIGLMQAVQGARR

SEQ ID NO: 35 - DNA, 1063 bp, Mycobacterium tuberculosis
  CDS (53)..(82)
  CDS (180)..(437)
  CDS (451)..(858)
  CDS (862)..(1062)
ccggtcggggggccgctaccagcgccagcgccggggctccccggtccgggtagtgcgcgtcgagttggtcgtggaccagcaatgactgcgacccggcgacttcgaaaccgccaccggttagattccccgactgcgtcatcgccaggtaaaccgccggcactaacgccagcaaccaacccgtgaagaccaaccaacggcacctgcgcaggttgcggctcaaccgcatcatgaactgctggatttcggactccccgtactctcgcgcagtgcgtgcccgcgagcctaccgaagatcgcgtgcatgcgttcggcgtggaccgcacagcacctggagttggcggcgccgagggccgagatggcaggatgacggatcgtcgggggcgggaactcccaggccgccggaccgtcgcaaacccgtcgcaaacccgtcgcaaaccgtaaggagtcatccatgaagacaggcaccgcgacgacgcggcgcaggctgttggcagtactgatcgccctcgcgttgccgggggccgccgttgcgctgctggccgaaccatcagcgaccggcgcgtcggacccgtgcgcggccagcgaagtggcgaggacggtcggttcggtcgccaagtcgatgggcgactacctggattcacacccagagaccaaccaggtgatgaccgcggtcttgcagcagcaggtagggccggggtcggtcgcatcgctgaaggcccatttcgaggcgaatcccaaggtcgcatcggatctgcacgcgctttcgcaaccgctgaccgatctttcgactcggtgctcgctgccgatcagcggcctgcaggcgatcggtttgatgcaggcggtgcagggcgcccgccggtagatgccggaccgccgccgggtccggcgcagtcgacgtgaggcagcggtcgcctaccggggcggtgtctcgccgccttctggtcgcaggtcaggggtcggcgctggaccttgcggtgtggtttcgaccgggtcgtcgcagggtgtgccctgcggttggatgacaagtcgcaggtttggatcggttggcgggtcgcgatcgttgt

SEQ ID NO: 36 - protein, 299 aa, Mycobacterium tuberculosis
VRVELVVDQQVKTNQRHLRRLRLNRIMNCWISDSPYSRAVRAREPTEDRVHAFGVDRTAPGVGGAEGRDGRMTDRRGRELPGRRTVANPSQTRRKPMKTGTATTRRRLLAVLIALALPGAAVALLAEPSATGASDPCAASEVARTVGSVAKSMGDYLDSHPETNQVMTAVLQQQVGPGSVASLKAHFEANPKVASDLHALSQPLTDLSTRCSLPISGLQAIGLMQAVQGARRMPDRRRVRRSRREAAVAYRGGVSPPSGRRSGVGAGPCGVVSTGSSQGVPCGWMTSRRFGSVGGSRSL

SEQ ID NO: 37 - protein, 10 aa, Mycobacterium tuberculosis
VRVELVVDQQ

SEQ ID NO: 38 - protein, 86 aa, Mycobacterium tuberculosis
VKTNQRHLRRLRLNRIMNCWISDSPYSRAVRAREPTEDRVHAFGVDRTAPGVGGAEGRDGRMTDRRGRELPGRRTVANPSQTRRKP

SEQ ID NO: 39 - protein, 136 aa, Mycobacterium tuberculosis; identical to SEQ ID NO: 32

SEQ ID NO: 40 - protein, 67 aa, Mycobacterium tuberculosis
MPDRRRVRRSRREAAVAYRGGVSPPSGRRSGVGAGPCGVVSTGSSQGVPCGWMTSRRFGSVGGSRSL

SEQ ID NO: 41 - DNA, 304 bp, Mycobacterium tuberculosis
  CDS (1)..(21)
  CDS (28)..(60)
  CDS (64)..(120)
  CDS (124)..(303)
tcgccggctcgcggacgtagataatagctcaccgttggacgacctcgacagggtcctttgtgactgccgggcttgacgcggacgaccacagagtcgggtcatcgcctaaggctaccgttctgacctggggtgcgtgggcgccgacgagtgaggcagtcatgtctcagggcccaccgccacctcggtcgccggcagtgtcagcatgtgcagatgactccacgcagcttgttcgtgttggtgtcgtggttgcgacgacttggcgctggtgagcgcacccgccggcgtcgtgccgcgcatgcggatc

SEQ ID NO: 42 - protein, 7 aa, Mycobacterium tuberculosis
SPARGRR

SEQ ID NO: 43 - protein, 11 aa, Mycobacterium tuberculosis
LTVGRPRQGPL

SEQ ID NO: 44 - protein, 19 aa, Mycobacterium tuberculosis
LPGLTRTTTESGHRLRLPF

SEQ ID NO: 45 - protein, 60 aa, Mycobacterium tuberculosis
PGVRGRRRVRQSCLRAHRHLGRRQCQHVQMTPRSLFVLVSWLRRLGAGERTRRRRAAHAD

SEQ ID NO: 46 - DNA, 303 bp, Mycobacterium tuberculosis
  CDS (1)..(72)
  CDS (76)..(105)
  CDS (109)..(147)
  CDS (151)..(210)
  CDS (214)..(303)
cgccggctcgcggacgtagataatagctcaccgttggacgacctcgacagggtcctttgtgactgccgggcttgacgcggacgaccacagagtcgggtcatcgcctaaggctaccgttctgacctggggtgcgtgggcgccgacgagtgaggcagtcatgtctcagggcccaccgccacctcggtcgccggcagtgtcagcatgtgcagatgactccacgcagcttgttcgtgttggtgtcgtggttgcgacgacttggcgctggtgagcgcacccgccggcgtcgtgccgcgcatgcggatc

SEQ ID NO: 47 - protein, 24 aa, Mycobacterium tuberculosis
RRLADVDNSSPLDDLDRVLCDCRA

SEQ ID NO: 48 - protein, 10 aa, Mycobacterium tuberculosis
RGRPQSRVIA

SEQ ID NO: 49 - protein, 13 aa, Mycobacterium tuberculosis
GYRSDLGCVGADE

SEQ ID NO: 50 - protein, 20 aa, Mycobacterium tuberculosis
GSHVSGPTATSVAGSVSMCR

SEQ ID NO: 51 - protein, 30 aa, Mycobacterium tuberculosis
LHAACSCWCRGCDDLALVSAPAGVVPRMRI

SEQ ID NO: 52 - DNA, 302 bp, Mycobacterium tuberculosis
  CDS (1)..(15)
  CDS (19)..(264)
  CDS (268)..(300)
gccggctcgcggacgtagataatagctcaccgttggacgacctcgacagggtcctttgtgactgccgggcttgacgcggacgaccacagagtcgggtcatcgcctaaggctaccgttctgacctggggtgcgtgggcgccgacgagtgaggcagtcatgtctcagggcccaccgccacctcggtcgccggcagtgtcagcatgtgcagatgactccacgcagcttgttcgtgttggtgtcgtggttgcgacgacttggcgctggtgagcgcacccgccggcgtcgtgccgcgcatgcggatc

SEQ ID NO: 53 - protein, 5 aa, Mycobacterium tuberculosis
AGSRT

SEQ ID NO: 54 - protein, 82 aa, Mycobacterium tuberculosis
IIAHRWTTSTGSFVTAGLDADDHRVGSSPKATVLTWGAWAPTSEAVMSQGPPPPRSPAVSACADDSTQLVRVGVVVATTWRW

SEQ ID NO: 55 - protein, 11 aa, Mycobacterium tuberculosis
AHPPASCRACG

SEQ ID NO: 56 - DNA, 389 bp, Mycobacterium tuberculosis
  CDS (1)..(114)
  CDS (118)..(183)
  CDS (187)..(237)
  CDS (241)..(282)
  CDS (286)..(387)
ccaattttccttcgcgccgtgcaataccatctgcaagaccagcgacggcccgtggttgcggtcgcgcagcttgcggaaaccgggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccgcgcgcgacttccagacatttgttgtggtttcggttgaggccgaggcgaggctcatttcgcagcaaccggtctccgggtcgcagcatcgttgcggcgatcgcggcgcagtcgtcggacgagtcgtcgtcaacgaccacgatc

SEQ ID NO: 57 - protein, 38 aa, Mycobacterium tuberculosis
PIFLRAVQYHLQDQRRPVVAVAQLAETGYGPCRTVVAT

SEQ ID NO: 58 - protein, 22 aa, Mycobacterium tuberculosis
CRRSPPVGGRKPFRHWDPQNVG

SEQ ID NO: 59 - protein, 17 aa, Mycobacterium tuberculosis
VSAGLRGAADHHHVRTE

SEQ ID NO: 60 - protein, 14 aa, Mycobacterium tuberculosis
VPRARLPDICCGFG

SEQ ID NO: 61 - protein, 34 aa, Mycobacterium tuberculosis
GRGEAHFAATGLRVAASLRRSRRSRRTSRRQRPR

SEQ ID NO: 62 - DNA, 388 bp, Mycobacterium tuberculosis
  CDS (1)..(387)
caattttccttcgcgccgtgcaataccatctgcaagaccagcgacggcccgtggttgcggtcgcgcagcttgcggaaaccgggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccgcgcgcgacttccagacatttgttgtggtttcggttgaggccgaggcgaggctcatttcgcagcaaccggtctccgggtcgcagcatcgttgcggcgatcgcggcgcagtcgtcggacgagtcgtcgtcaacgaccacgatc

SEQ ID NO: 63 - protein, 129 aa, Mycobacterium tuberculosis
QFSFAPCNTICKTSDGPWLRSRSLRKPGMDPAVPLLPLDVVALHPSGGESHSDTGILKTSAECLQGSGEQPIITMYELNKSPARDFQTFVVVSVEAEARLISQQPVSGSQHRCGDRGAVVGRVVVNDHD

SEQ ID NO: 64 - DNA, 387 bp, Mycobacterium tuberculosis
  CDS (1)..(231)
  CDS (235)..(387)
aattttccttcgcgccgtgcaataccatctgcaagaccagcgacggcccgtggttgcggtcgcgcagcttgcggaaaccgggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccgcgcgcgacttccagacatttgttgtggtttcggttgaggccgaggcgaggctcatttcgcagcaaccggtctccgggtcgcagcatcgttgcggcgatcgcggcgcagtcgtcggacgagtcgtcgtcaacgaccacgatc

SEQ ID NO: 65 - protein, 77 aa, Mycobacterium tuberculosis
NFPSRRAIPSARPATARGCGRAACGNRVWTLPYRCCHLMSSLSTRRGAKAIPTLGSSKRRLSVCRAPGSSRSSPCTN

SEQ ID NO: 66 - protein, 51 aa, Mycobacterium tuberculosis
ISPPRATSRHLLWFRLRPRRGSFRSNRSPGRSIVAAIAAQSSDESSSTTTI

SEQ ID NO: 67 - DNA, 144 bp, Mycobacterium tuberculosis
  CDS (1)..(144)
ccgcgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 68 - protein, 48 aa, Mycobacterium tuberculosis
PRATSRHLLWFRLRPRRGSFRSKRSPGRSIVAAIAAQSSDESSSTTTI

SEQ ID NO: 69 - DNA, 143 bp, Mycobacterium tuberculosis
  CDS (1)..(36)
  CDS (40)..(141)
cgcgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 70 - protein, 12 aa, Mycobacterium tuberculosis
RARLPDICCGFG

SEQ ID NO: 71 - protein, 34 aa, Mycobacterium tuberculosis
GRGEAHFAASGLRVAASLRRSRRSRRTSRRQRPR

SEQ ID NO: 72 - DNA, 145 bp, Mycobacterium tuberculosis
  CDS (1)..(144)
gccgcgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 73 - protein, 48 aa, Mycobacterium tuberculosis
AARDFQTFVVVSVEAEARLISQQAVSGSQHRCGDRGAVVGRVVVNDHD

SEQ ID NO: 74 - DNA, 318 bp, Mycobacterium tuberculosis
  CDS (4)..(315)
tgaataagtccgccgcgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatctcgaactcgacgccctcctgttcgaggatgctacgcagacagcgctcgatggtggcgccgttgttgtacatcgggatgcacaccgagataagcggtttcgccgggttcaccgataccacgcttgatgcatcaccaggcaccacatggcgactcagagactag

SEQ ID NO: 75 - protein, 104 aa, Mycobacterium tuberculosis
ISPPRATSRHLLWFRLRPRRGSFRSKRSPGRSIVAAIAAQSSDESSSTTTISNSTPSCSRMLRRQRSMVAPLLYIGMHTEISGFAGFTDTTLDASPGTTWRLRD

SEQ ID NO: 76 - DNA, 61 bp, Mycobacterium tuberculosis
  CDS (1)..(60)
gcaacctaccagcagagccaggggctcacaggacctaaaggagtagcgcccatggctgatc

SEQ ID NO: 77 - protein, 20 aa, Mycobacterium tuberculosis
ATYQQSQGLTGPKGVAPMAD

SEQ ID NO: 78 - DNA, 63 bp, Mycobacterium tuberculosis
  CDS (1)..(45)
  CDS (49)..(63)
acgcaacctaccagcagagccaggggctcacaggacctaaaggagtagcgcccatggctgatc

SEQ ID NO: 79 - protein, 15 aa, Mycobacterium tuberculosis
TQPTSRARGSQDLKE

SEQ ID NO: 80 - protein, 5 aa, Mycobacterium tuberculosis
RPWLI

SEQ ID NO: 81 - DNA, 62 bp, Mycobacterium tuberculosis
  CDS (1)..(36)
  CDS (40)..(57)
cgcaacctaccagcagagccaggggctcacaggacctaaaggagtagcgcccatggctgatc

SEQ ID NO: 82 - protein, 12 aa, Mycobacterium tuberculosis
RNLPAEPGAHRT

SEQ ID NO: 83 - protein, 6 aa, Mycobacterium tuberculosis
RSSAHG

SEQ ID NO: 84 - DNA, 336 bp, Mycobacterium tuberculosis
  CDS (1)..(333)
atggctgatcgtgtcctgaggggcagtcgcctcggagccgtgagctatgagaccgaccgcaaccacgacctggcgccgcgccagatcgcgcggtaccgcaccgacaacggcgaggagttcgaagtcccgttcgccgatgacgccgagatccccggcacctggttgtgccgcaacggcatggaaggcaccctgatcgagggcgacctgcccgagccgaagaaggttaagccgccccggacgcactgggacatgctgctggagcgccgttccatcgaagaactcgaagagttacttaaggagcgcctcgagctcattcggtcacgtcggcgcggctga

SEQ ID NO: 85 - protein, 111 aa, Mycobacterium tuberculosis
MADRVLRGSRLGAVSYETDRNHDLAPRQIARYRTDNGEEFEVPFADDAEIPGTWLCRNGMEGTLIEGDLPEPKKVKPPRTHWDMLLERRSIEELEELLKERLELIRSRRRG

SEQ ID NO: 86 - DNA, 501 bp, Mycobacterium tuberculosis
  CDS (4)..(498)
tagtccgcccgggtgtccgatcccggtatcattgatggtcgcgccgcgcgcgtcgcgtgccgggaactacgcagacggccgcagcgtttgccaaccggagccagtcgccagtacgcaacctaccagcagagcccagggctcacaggacctaaaggagtagcgcccatggctgatcgtgtcctgaggggcagtcgcctcggagccgtgagctatgagaccgaccgcaaccacgacctggcgccgcgccagatcgcgcggtaccgcaccgacaacggcgaggagttcgaagtcccgttcgccgatgacgccgagatccccggcacctggttgtgccgcaacggcatggaaggcaccctgatcgagggcgacctgcccgagccgaagaaggttaagccgccccggacgcactgggacatgctgctggagcgccgttccatcgaagaactcgaagagttacttaaggagcgcctcgagctcattcggtcacgtcggcgcggctga

SEQ ID NO: 87 - protein, 165 aa, Mycobacterium tuberculosis
SARVSDPGIIDGRAARVACRELRRRPQRLPTGASRQYATYQQSPGLTGPKGVAPMADRVLRGSRLGAVSYETDRNHDLAPRQIARYRTDNGEEFEVPFADDAEIPGTWLCRNGMEGTLIEGDLPEPKKVKPPRTHWDMLLERRSIEELEELLKERLELIRSRRRG

SEQ ID NO: 88 - DNA, 316 bp, Mycobacterium tuberculosis
  CDS (1)..(315)
gatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 89 - protein, 105 aa, Mycobacterium tuberculosis
DRGQRGRIRRDVGPRRRRDVWLRRGDGDGDGDVAAVRGGAGDDQRGWAPRAGRRGRGGLRHRRGEPVDEQCAPGAATAGPAHAGHHAFFQAGWPVEDGLAASVAD

SEQ ID NO: 90 - DNA, 315 bp, Mycobacterium tuberculosis
  CDS (1)..(315)
atcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 91 - protein, 105 aa, Mycobacterium tuberculosis
IAVNEAEYGEMWAQDAAAMFGYAAATATATATLLPFEEAPEMTSAGGLLEQAAAVEEASDTAAANQLMNNVPQALQQLAQPTQGTTPSSKLGGLWKTVSPHRSPI

SEQ ID NO: 92 - DNA, 314 bp, Mycobacterium tuberculosis
  CDS (1)..(23)
  CDS (127)..(198)
  CDS (205)..(312)
tcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 93 - protein, 41 aa, Mycobacterium tuberculosis
SRSTRPNTARCGPKTPPRCLATPRRRRRRRRRCCRSRRRRR

SEQ ID NO: 94 - protein, 24 aa, Mycobacterium tuberculosis
PARVGSSSRPPRSRRPPTPPRRTS

SEQ ID NO: 95 - protein, 36 aa, Mycobacterium tuberculosis
TMCPRRCNSWPSPRRAPRLLPSWVACGRRSRRIGRR

SEQ ID NO: 96 - DNA, 250 bp, Mycobacterium tuberculosis
  CDS (1)..(249)
cgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 97 - protein, 83 aa, Mycobacterium tuberculosis
RRGDGDGDGDVAAVRGGAGDDQRGWAPRAGRRGRGGLRHRRGEPVDEQCAPGAATAGPAHAGHHAFFQAGWPVEDGLAASVAD

SEQ ID NO: 98 - DNA, 252 bp, Mycobacterium tuberculosis
  CDS (1)..(252)
tacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 99 - protein, 84 aa, Mycobacterium tuberculosis
YAAATATATATLLPFEEAPEMTSAGGLLEQAAAVEEASDTAAANQLMNNVPQALQQLAQPTQGTTPSSKLGGLWKTVSPHRSPI

SEQ ID NO: 100 - DNA, 251 bp, Mycobacterium tuberculosis
  CDS (1)..(60)
  CDS (64)..(135)
  CDS (142)..(249)
acgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatc

SEQ ID NO: 101 - protein, 20 aa, Mycobacterium tuberculosis
TPRRRRRRRRRCCRSRRRRR

SEQ ID NO: 102 - protein, 24 aa, Mycobacterium tuberculosis
PARVGSSSRPPRSRRPPTPPRRTS

SEQ ID NO: 103 - protein, 36 aa, Mycobacterium tuberculosis; identical to SEQ ID NO: 95

SEQ ID NO: 104 - DNA, 858 bp, Mycobacterium tuberculosis
  CDS (4)..(855)
tgaactgatgattctgatagcgaccaacctcttggggcaaaacaccccggcgatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatcagcaacatggtgtcgatggccaacaaccacatgtcgatgaccaactcgggtgtgtcgatgaccaacaccttgagctcgatgttgaagggctttgctccggcggcggccgcccaggccgtgcaaaccgcggcgcaaaacggggtccgggcgatgagctcgctgggcagctcgctgggttcttcgggtctgggcggtggggtggccgccaacttgggtcgggcggcctcggtcggttcgttgtcggtgccgcaggcctgggccgcggccaaccaggcagtcaccccggcggcgcgggcgctgccgctgaccagcctgaccagcgccgcggaaagagggcccgggcagatgctgggcgggctgccggtggggcagatgggcgccagggccggtggtgggctcagtggtgtgctgcgtgttccgccgcgaccctatgtgatgccgcattctccggcggccggctaggagagggggcgcagactgtcgttatttga

SEQ ID NO: 105 - protein, 284 aa, Mycobacterium tuberculosis
TDDSDSDQPLGAKHPGDRGQRGRIRRDVGPRRRRDVWLRRGDGDGDGDVAAVRGGAGDDQRGWAPRAGRRGRGGLRHRRGEPVDEQCAPGAATAGPAHAGHHAFFQAGWPVEDGLAASVADQQHGVDGQQPHVDDQLGCVDDQHLELDVEGLCSGGGRPGRANRGAKRGPGDELAGQLAGFFGSGRWGGRQLGSGGLGRFVVGAAGLGRGQPGSHPGGAGAAADQPDQRRGKRARADAGRAAGGADGRQGRWWAQWCAACSAATLCDAAFSGGRLGEGAQTVVI

SEQ ID NO: 106 - DNA, 1176 bp, Mycobacterium tuberculosis
  CDS (1)..(1173)
atggtggatttcggggcgttaccaccggagatcaactccgcgaggatgtacgccggcccgggttcggcctcgctggtggccgcggctcagatgtgggacagcgtggcgagtgacctgttttcggccgcgtcggcgtttcagtcggtggtctggggtctgacggtggggtcgtggataggttcgtcggcgggtctgatggtggcggcggcctcgccgtatgtggcgtggatgagcgtcaccgcggggcaggccgagctgaccgccgcccaggtccgggttgctgcggcggcctacgagacggcgtatgggctgacggtgcccccgccggtgatcgccgagaaccgtgctgaactgatgattctgatagcgaccaacctcttggggcaaaacaccccggcgatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatcagcaacatggtgtcgatggccaacaaccacatgtcgatgaccaactcgggtgtgtcgatgaccaacaccttgagctcgatgttgaagggctttgctccggcggcggccgcccaggccgtgcaaaccgcggcgcaaaacggggtccgggcgatgagctcgctgggcagctcgctgggttcttcgggtctgggcggtggggtggccgccaacttgggtcgggcggcctcggtcggttcgttgtcggtgccgcaggcctgggccgcggccaaccaggcagtcaccccggcggcgcgggcgctgccgctgaccagcctgaccagcgccgcggaaagagggcccgggcagatgctgggcgggctgccggtggggcagatgggcgccagggccggtggtgggctcagtggtgtgctgcgtgttccgccgcgaccctatgtgatgccgcattctccggcggccggctag

SEQ ID NO: 107 - protein, 391 aa, Mycobacterium tuberculosis
MVDFGALPPEINSARMYAGPGSASLVAAAQMWDSVASDLFSAASAFQSVVWGLTVGSWIGSSAGLMVAAASPYVAWMSVTAGQAELTAAQVRVAAAAYETAYGLTVPPPVIAENRAELMILIATNLLGQNTPAIAVNEAEYGEMWAQDAAAMFGYAAATATATATLLPFEEAPEMTSAGGLLEQAAAVEEASDTAAANQLMNNVPQALQQLAQPTQGTTPSSKLGGLWKTVSPHRSPISNMVSMANNHMSMTNSGVSMTNTLSSMLKGFAPAAAAQAVQTAAQNGVRAMSSLGSSLGSSGLGGGVAANLGRAASVGSLSVPQAWAAANQAVTPAARALPLTSLTSAAERGPGQMLGGLPVGQMGARAGGGLSGVLRVPPRPYVMPHSPAAG

SEQ ID NO: 108 - DNA, 1188 bp, Mycobacterium tuberculosis
  CDS (4)..(1185)
tagggacacgtaatggtggatttcggggcgttaccaccggagatcaactccgcgaggatgtacgccggcccgggttcggcctcgctggtggccgcggctcagatgtgggacagcgtggcgagtgacctgttttcggccgcgtcggcgtttcagtcggtggtctggggtctgacggtggggtcgtggataggttcgtcggcgggtctgatggtggcggcggcctcgccgtatgtggcgtggatgagcgtcaccgcggggcaggccgagctgaccgccgcccaggtccgggttgctgcggcggcctacgagacggcgtatgggctgacggtgcccccgccggtgatcgccgagaaccgtgctgaactgatgattctgatagcgaccaacctcttggggcaaaacaccccggcgatcgcggtcaacgaggccgaatacggcgagatgtgggcccaagacgccgccgcgatgtttggctacgccgcggcgacggcgacggcgacggcgacgttgctgccgttcgaggaggcgccggagatgaccagcgcgggtgggctcctcgagcaggccgccgcggtcgaggaggcctccgacaccgccgcggcgaaccagttgatgaacaatgtgccccaggcgctgcaacagctggcccagcccacgcagggcaccacgccttcttccaagctgggtggcctgtggaagacggtctcgccgcatcggtcgccgatcagcaacatggtgtcgatggccaacaaccacatgtcgatgaccaactcgggtgtgtcgatgaccaacaccttgagctcgatgttgaagggctttgctccggcggcggccgcccaggccgtgcaaaccgcggcgcaaaacggggtccgggcgatgagctcgctgggcagctcgctgggttcttcgggtctgggcggtggggtggccgccaacttgggtcgggcggcctcggtcggttcgttgtcggtgccgcaggcctgggccgcggccaaccaggcagtcaccccggcggcgcgggcgctgccgctgaccagcctgaccagcgccgcggaaagagggcccgggcagatgctgggcgggctgccggtggggcagatgggcgccagggccggtggtgggctcagtggtgtgctgcgtgttccgccgcgaccctatgtgatgccgcattctccggcggccggctag

SEQ ID NO: 109 - protein, 394 aa, Mycobacterium tuberculosis
GHVMVDFGALPPEINSARMYAGPGSASLVAAAQMWDSVASDLFSAASAFQSVVWGLTVGSWIGSSAGLMVAAASPYVAWMSVTAGQAELTAAQVRVAAAAYETAYGLTVPPPVIAENRAELMILIATNLLGQNTPAIAVNEAEYGEMWAQDAAAMFGYAAATATATATLLPFEEAPEMTSAGGLLEQAAAVEEASDTAAANQLMNNVPQALQQLAQPTQGTTPSSKLGGLWKTVSPHRSPISNMVSMANNHMSMTNSGVSMTNTLSSMLKGFAPAAAAQAVQTAAQNGVRAMSSLGSSLGSSGLGGGVAANLGRAASVGSLSVPQAWAAANQAVTPAARALPLTSLTSAAERGPGQMLGGLPVGQMGARAGGGLSGVLRVPPRPYVMPHSPAAG

SEQ ID NO: 110 - DNA, 433 bp, Mycobacterium tuberculosis
  CDS (1)..(6)
  CDS (10)..(114)
  CDS (118)..(432)
ggatcctgatgcaagtggtccgggatttgtcggcagccaccgcggtcccgtcgaccaacgttggtgcatccgggctgcgagcatgcacgcaccgaccagcgcggcgagcgcggctagctgcttgcccactgttcctccctgccggcaccatgtgcgacaagcttaagcgcagcagtaccggcggtgcctgggcatccagcaaaacggggagctcaagaacgattcatgaacgaggggtcgtcaccaacgtcgaaaccgacggttgccagccggcccacgatattgcgtgctcgagggtccgctgtaccctcaccgaacgtgagtcccacaccgcggaggcgggcgactctggcgtcgttagcagccgagctcaaggtgtcccgcaccactgtctcgaatgcttttaaccgaccggatccagaaggagaagatc

SEQ ID NO: 111 - protein, 35 aa, Mycobacterium tuberculosis
CKWSGICRQPPRSRRPTLVHPGCEHARTDQRGERG

SEQ ID NO: 112 - protein, 105 aa, Mycobacterium tuberculosis
LLAHCSSLPAPCATSLSAAVPAVPGHPAKRGAQERFMNEGSSPTSKPTVASRPTILRARGSAVPSPNVSPTPRRRATLASLAAELKVSRTTVSNAFNRPDPEGED

SEQ ID NO: 113 - DNA, 432 bp, Mycobacterium tuberculosis
  CDS (1)..(162)
  CDS (166)..(225)
  CDS (229)..(318)
  CDS (322)..(357)
  CDS (361)..(432)
gatcctgatgcaagtggtccgggatttgtcggcagccacggcggtcccgtcgaccaacgttggtgcatccgggctgcgagcatgcacgcaccgaccagcgcggcgagcgcggctagctgcttgcccactgttcctccctgccggcaccatgtgcgacaagcttaagcgcagcagtaccggcggtgcctgggcatccagcaaaacggggagctcaagaacgattcatgaacgaggggtcgtcaccaacgtcgaaaccgacggttgccagccggcccacgatattgcgtgctcgagggtccgctgtaccctcaccgaacgtgagtcccacaccgcggaggcgggcgactctggcgtcgttagcagccgagctcaaggtgtcccgcaccactgtctcgaatgcttttaaccgaccggatccagaaggagaagatc

SEQ ID NO: 114 - protein, 54 aa, Mycobacterium tuberculosis
DPDASGPGFVGSHGGPVDQRWCIRAASMHAPTSAASAASCLPTVPPCRHHVRQA

SEQ ID NO: 115 - protein, 20 aa, Mycobacterium tuberculosis
AQQYRRCLGIQQNGELKNDS

SEQ ID NO: 116 - protein, 30 aa, Mycobacterium tuberculosis
TRGRHQRRNRRLPAGPRYCVLEGPLYPHRT

SEQ ID NO: 117 - protein, 12 aa, Mycobacterium tuberculosis
VPHRGGGRLWRR

SEQ ID NO: 118 - protein, 24 aa, Mycobacterium tuberculosis
QPSSRCPAPLSRMLLTDRIQKEKI

SEQ ID NO: 119 - DNA, 431 bp, Mycobacterium tuberculosis
  CDS (1)..(402)
  CDS (406)..(429)
atcctgatgcaagtggtccgggatttgtcggcagccacggcggtcccgtcgaccaacgttggtgcatccgggctgcgagcatgcacgcaccgaccagcgcggcgagcgcggctagctgcttgcccactgttcctccctgccggcaccatgtgcgacaagcttaagcgcagcagtaccggcggtgcctgggcatccagcaaaacggggagctcaagaacgattcatgaacgaggggtcgtcaccaacgtcgaaaccgacggttgccagccggcccacgatattgcgtgctcgagggtccgctgtaccctcaccgaacgtgagtcccacaccgcggaggcgggcgactctggcgtcgttagcagccgagctcaaggtgtcccgcaccactgtctcgaatgcttttaaccgaccggatccagaaggagaagatc

SEQ ID NO: 120 - protein, 134 aa, Mycobacterium tuberculosis
ILMQVVRDLSAATAVPSTNVGASGLRACTHRPARRARLAACPLFLPAGTMCDKLKRSSTGGAWASSKTGSSRTIHERGVVTNVETDGCQPAHDIACSRVRCTLTERESHTAEAGDSGVVSSRAQGVPHHCLECF

SEQ ID NO: 121 - protein, 8 aa, Mycobacterium tuberculosis
PTGSRRRR

SEQ ID NO: 122 - DNA, 324 bp, Mycobacterium tuberculosis
  CDS (1)..(30)
  CDS (34)..(102)
  CDS (106)..(165)
  CDS (169)..(267)
  CDS (271)..(273)
  CDS (277)..(324)
ccgtcggcaacttggccgctgaggtcggcttgatccctgggccgaggcgggtcagccaatagcggctccatcggctttgctggtagcggttcggcgggaagctagcggcgacgttgtcggtggccggtgatatattcggtcagacgggtatggcggcggctgaggtgatctgcgacacgccgccgcggtgctcgagccaggcttacgaccagggaatttcgaaaatgttattcagaacatcttgtatctcttctccgtgccaccccctaggtgtagtgttttcgagtaccggcagatcccaggttcaccaggtctcaccagatc

SEQ ID NO: 123 - protein, 10 aa, Mycobacterium tuberculosis
PSATWPLRSA

SEQ ID NO: 124 - protein, 23 aa, Mycobacterium tuberculosis
SLGRGGSANSGSIGFAGSGSAGS

SEQ ID NO: 125 - protein, 20 aa, Mycobacterium tuberculosis
RRRCRWPVIYSVRRVWRRLR

SEQ ID NO: 126 - protein, 33 aa, Mycobacterium tuberculosis
SATRRRGARARLTTREFRKCYSEHLVSLLRATP

SEQ ID NO: 127 - protein, 16 aa, Mycobacterium tuberculosis
CFRVPADPRFTRSHQI

SEQ ID NO: 128 - DNA, 323 bp, Mycobacterium tuberculosis
  CDS (1)..(18)
  CDS (22)..(126)
  CDS (130)..(159)
  CDS (163)..(321)
cgtcggcaacttggccgctgaggtcggcttgatccctgggccgaggcgggtcagccaatagcggctccatcggctttgctggtagcggttcggcgggaagctagcggcgacgttgtcggtggccggtgatatattgggtcagacgggtatggcggcggctgaggtgatctgcgacacgccgccgcggtgctcgagccaggcttacgaccagggaatttcgaaaatgttattcagaacatcttgtatctcttctccgtgccaccccctaggtgtagtgttttcgagtaccggcagatcccaggttcaccaggtctcaccagatc

SEQ ID NO: 129 - protein, 6 aa, Mycobacterium tuberculosis
RRQLGR

SEQ ID NO: 130 - protein, 35 aa, Mycobacterium tuberculosis
GRLDPWAEAGQPIAAPSALLVAVRREASGDVVGGR

SEQ ID NO: 131 - protein, 10 aa, Mycobacterium tuberculosis
YIGSDGYGGG

SEQ ID NO: 132 - protein, 53 aa, Mycobacterium tuberculosis
GDLRHAAAVLEPGLRPGNFENVIQNILYLFSVPPPRCSVFEYRQIPGSPGLTR

SEQ ID NO: 133 - DNA, 322 bp, Mycobacterium tuberculosis
  CDS (1)..(57)
  CDS (61)..(81)
  CDS (85)..(321)
gtcggcaacttggccgctgaggtcggcttgatccctgggccgaggcgggtcagccaatagcggctccatcggctttgctggtagcggttcggcgggaagctagcggcgacgttgtcggtggccggtgatatattgggtcagacgggtatggcggcggctgaggtgatctgcgacacgccgccgcggtgctcgagccaggcttacgaccagggaatttcgaaaatgttattcagaacatcttgtatctcttctccgtgccaccccctaggtgtagtgttttcgagtaccggcagatcccaggttcaccaggtctcaccagatc

SEQ ID NO: 134 - protein, 19 aa, Mycobacterium tuberculosis
VGNLAAEVGLIPGPRRVSQ

SEQ ID NO: 135 - protein, 7 aa, Mycobacterium tuberculosis
RLHRLCW

SEQ ID NO: 136 - protein, 79 aa, Mycobacterium tuberculosis
RFGGKLAATLSVAGDILGQTGMAAAEVICDTPPRCSSQAYDQGISKMLFRTSCISSPCHPLGVVFSSTGRSQVHQVSPD

SEQ ID NO: 137 - DNA, 432 bp, Mycobacterium tuberculosis
  CDS (1)..(60)
  CDS (64)..(72)
  CDS (76)..(84)
  CDS (88)..(96)
  CDS (100)..(261)
  CDS (265)..(432)
ctttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 138 - protein, 20 aa, Mycobacterium tuberculosis
LCVMSNGENDALSSQSSAPA

SEQ ID NO: 139 - DNA, 431 bp, Mycobacterium tuberculosis
  CDS (1)..(6)
  CDS (10)..(429)
tttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 140 - protein, 140 aa, Mycobacterium tuberculosis
CPMAKTTPCHRNRQHRPSFRDDARSDRTCERVSGRGRANRRFHGCRRIRGQGRRGRTVPGFDTIRPNRPAPGCSCAWRLGCRPTSDCAVDDPAGHVSAKRHRVRGTRARTRHAAGLGRSGAIDAGRGRGVEHAGPKPRRR

SEQ ID NO: 141 - DNA, 430 bp, Mycobacterium tuberculosis
  CDS (1)..(429)
ttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 142 - protein, 143 aa, Mycobacterium tuberculosis
LRDVQWRKRRLVIAIVSTGLVFAMTLVLTGLVNGFRVEAERTVDSMGVDAFVVKAGAAGPFLGSTPFAQIDLPQVARAPGVLAAAPLATAPSTIRQGTSARNVTAFGAPEHGPGMPRVSDGRAPSTPDEVAVSSTLGRNLGDD

SEQ ID NO: 143 - DNA, 211 bp, Mycobacterium tuberculosis
  CDS (1)..(210)
caggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 144 - protein, 70 aa, Mycobacterium tuberculosis
QVARAPGVLAAAPLATAPSTIRQGTSARNVTAFGAPEHGPGMPRVSDGRAPSTPDEVAVSSTLGRNLGDD

SEQ ID NO: 145 - DNA, 210 bp, Mycobacterium tuberculosis
  CDS (1)..(39)
  CDS (43)..(210)
aggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 146 - protein, 13 aa, Mycobacterium tuberculosis
RLLVRLASWLPPH

SEQ ID NO: 147 - protein, 56 aa, Mycobacterium tuberculosis
RLRRRRSGRARQRETSPRSGHQSTDPACRGSRTVGRHRRRTRSRCRARWAETSATI

SEQ ID NO: 148 - DNA, 212 bp, Mycobacterium tuberculosis
  CDS (1)..(210)
ccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 149 - protein, 70 aa, Mycobacterium tuberculosis
PGCSCAWRLGCRPTSDCAVDDPAGHVSAKRHRVRGTRARTRHAAGLGRSGAIDAGRGRGVEHAGPKPRRR

SEQ ID NO: 150 - DNA, 1047 bp, Mycobacterium tuberculosis
  CDS (1)..(1044)
ctttttgcggctttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatctgcaagtgggtgcgcgcactttgcggatcgtcggcatcgtgcccgagtcaaccgcgctggcaaagattcccaacatcttcctgaccaccgaaggcctacagcagttggcatacaacggacagccgacaatcagttcgatcgggatcgacgggatgccccgacagctcccggacggctatcagaccgtcaatcgagcggatgctgtcagcgatctgatgcgcccgttgaaggtcgcggtggatgcgatcacggttgtggcggtcttgctgtggatcgttgcggcgttgatcgtcggctcggtggtctacctctctgcgttggagcggctgcgtgactttgcggtgttcaaggcgatcggcgtgccgacgcgctcgattctggccgggctggcgctgcaggcggtcgtcgtcgcgctgctcgcggcggtggttggcggcatcctttcgctgctgttggcgccgttgttcccgatgactgtcgtggtacccctgagtgccttcgtggcgctaccggcgatcgcgactgtgatcggtctgctggccagcgtcgcaggactgcggcgcgtggtggcgatcgatccggcactagcgttcggaggtccctag

SEQ ID NO: 151 - protein, 348 aa, Mycobacterium tuberculosis
LFAALRDVQWRKRRLVIAIVSTGLVFAMTLVLTGLVNGFRVEAERTVDSMGVDAFVVKAGAAGPFLGSTPFAQIDLPQVARAPGVLAAAPLATAPSTIRQGTSARNVTAFGAPEHGPGMPRVSDGRAPSTPDEVAVSSTLGRNLGDDLQVGARTLRIVGIVPESTALAKIPNIFLTTEGLQQLAYNGQPTISSIGIDGMPRQLPDGYQTVNRADAVSDLMRPLKVAVDAITVVAVLLWIVAALIVGSVVYLSALERLRDFAVFKAIGVPTRSILAGLALQAVVVALLAAVVGGILSLLLAPLFPMTVVVPLSAFVALPAIATVIGLLASVAGLRRVVAIDPALAFGGP

SEQ ID NO: 152 - DNA, 1269 bp, Mycobacterium tuberculosis
  CDS (4)..(1266)
taggtttcaagaaggcctgtgcaggtttccgcagcctgggccgcggcgccaccgaagagcccgccgaaatgggctaatcgggttcgcttggctcgatcgccgatgatctcgaccgccacgaccgaccccctcacctcggtcgaacctcggcgaaccaacgcggcaacgccagcccatgatcatttgattgggtccacggaagcaggtagcttccgtcgcatgctttttgcggctttgcgtgatgtccaatggcgaaaacgacgccttgtcatcgcaatcgtcagcaccggcctagttttcgcgatgacgctcgttctgaccggacttgtgaacgggtttcgggtcgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatctgcaagtgggtgcgcgcactttgcggatcgtcggcatcgtgcccgagtcaaccgcgctggcaaagattcccaacatcttcctgaccaccgaaggcctacagcagttggcatacaacggacagccgacaatcagttcgatcgggatcgacgggatgccccgacagctcccggacggctatcagaccgtcaatcgagcggatgctgtcagcgatctgatgcgcccgttgaaggtcgcggtggatgcgatcacggttgtggcggtcttgctgtggatcgttgcggcgttgatcgtcggctcggtggtctacctctctgcgttggagcggctgcgtgactttgcggtgttcaaggcgatcggcgtgccgacgcgctcgattctggccgggctggcgctgcaggcggtcgtcgtcgcgctgctcgcggcggtggttggcggcatcctttcgctgctgttggcgccgttgttcccgatgactgtcgtggtacccctgagtgccttcgtggcgctaccggcgatcgcgactgtgatcggtctgctggccagcgtcgcaggactgcggcgcgtggtggcgatcgatccggcactagcgttcggaggtccctag

SEQ ID NO: 153 - protein, 421 aa, Mycobacterium tuberculosis
VSRRPVQVSAAWAAAPPKSPPKWANRVRLARSPMISTATTDPLTSVEPRRTNAATPAHDHLIGSTEAGSFRRMLFAALRDVQWRKRRLVIAIVSTGLVFAMTLVLTGLVNGFRVEAERTVDSMGVDAFVVKAGAAGPFLGSTPFAQIDLPQVARAPGVLAAAPLATAPSTIRQGTSARNVTAFGAPEHGPGMPRVSDGRAPSTPDEVAVSSTLGRNLGDDLQVGARTLRIVGIVPESTALAKIPNIFLTTEGLQQLAYNGQPTISSIGIDGMPRQLPDGYQTVNRADAVSDLMRPLKVAVDAITVVAVLLWIVAALIVGSVVYLSALERLRDFAVFKAIGVPTRSILAGLALQAVVVALLAAVVGGILSLLLAPLFPMTVVVPLSAFVALPAIATVIGLLASVAGLRRVVAIDPALAFGGP

SEQ ID NO: 154 - DNA, 1050 bp, Mycobacterium tuberculosis
  CDS (1)..(1047)
atgctcttcgcggccctgcgtgacatgcaatggagaaagcgccgcctggtcatcacgatcatcagcaccgggctgatcttcgggatgacgcttgttttgaccggactcgcgaacggcttccgggtggaggcccggcacaccgtcgattccatgggtgtcgatgtattcgtcgtcagatccggcgctgctggaccttttctgggttcaataccgtttcccgatgttgacctggcccgagtggccgctgaacccggtgtcatggccgcggccccgttgggcagcgtggggacgatcatgaaagaaggcacgtcgacgcgaaacgtcacggtcttcggcgcgcccgagcacggacctggcatgccacgggtctcagagggtcggtcaccgtcgaaaccggacgaagtcgcggcatcgagcacgatgggccgacacctcggtgacactgtcgaggtcggcgcgcgcagattgcgggtcgttggcattgtgccgaattccaccgcgctggccaagatccccaatgtcttcctcacgaccgagggcttacagaaattggcgtacaacgggcagccgaatatcacgtccatcgggatcataggtatgccccgacagctgccggagggttaccagactttcgatcgggtgggcgctgtcaatgatttggtgcgcccattgaaggtcgcagtgaattcgatctcgatcgtggctgttttgctgtggattgtggcggtgctgatcgtcggctcggtggtgtacctttcggctcttgagcggctacgtgacttcgcggtgttcaaggcgattggcacgccaacgcgctcgattatggccgggctcgcattacaggcgctggtcattgcgttgcttgcggcggtggtgggcgtcgtcctggcgcaggtgttggcaccactgtttccgatgattgtcgcggtacccgtcggtgcttacctggcgctaccggtggccgcgatcgtcatcggtctgttcgctagtgttgccggattgaagcgcgtggtgacggtcgatcccgcgcaggcgttcggaggtccctag

SEQ ID NO: 155 - protein, 349 aa, Mycobacterium tuberculosis
MLFAALRDMQWRKRRLVITIISTGLIFGMTLVLTGLANGFRVEARHTVDSMGVDVFVVRSGAAGPFLGSIPFPDVDLARVAAEPGVMAAAPLGSVGTIMKEGTSTRNVTVFGAPEHGPGMPRVSEGRSPSKPDEVAASSTMGRHLGDTVEVGARRLRVVGIVPNSTALAKIPNVFLTTEGLQKLAYNGQPNITSIGIIGMPRQLPEGYQTFDRVGAVNDLVRPLKVAVNSISIVAVLLWIVAVLIVGSVVYLSALERLRDFAVFKAIGTPTRSIMAGLALQALVIALLAAVVGVVLAQVLAPLFPMIVAVPVGAYLALPVAAIVIGLFASVAGLKRVVTVDPAQAFGGP

SEQ ID NO: 156 - DNA, 1062 bp, Mycobacterium tuberculosis
  CDS (4)..(1059)
tagcctctgggaatgctcttcgcggccctgcgtgacatgcaatggagaaagcgccgcctggtcatcacgatcatcagcaccgggctgatcttcgggatgacgcttgttttgaccggactcgcgaacggcttccgggtggaggcccggcacaccgtcgattccatgggtgtcgatgtattcgtcgtcagatccggcgctgctggaccttttctgggttcaataccgtttcccgatgttgacctggcccgagtggccgctgaacccggtgtcatggccgcggccccgttgggcagcgtggggacgatcatgaaagaaggcacgtcgacgcgaaacgtcacggtcttcggcgcgcccgagcacggacctggcatgccacgggtctcagagggtcggtcaccgtcgaaaccggacgaagtcgcggcatcgagcacgatgggccgacacctcggtgacactgtcgaggtcggcgcgcgcagattgcgggtcgttggcattgtgccgaattccaccgcgctggccaagatccccaatgtcttcctcacgaccgagggcttacagaaattggcgtacaacgggcagccgaatatcacgtccatcgggatcataggtatgccccgacagctgccggagggttaccagactttcgatcgggtgggcgctgtcaatgatttggtgcgcccattgaaggtcgcagtgaattcgatctcgatcgtggctgttttgctgtggattgtggcggtgctgatcgtcggctcggtggtgtacctttcggctcttgagcggctacgtgacttcgcggtgttcaaggcgattggcacgccaacgcgctcgattatggccgggctcgcattacaggcgctggtcattgcgttgcttgcggcggtggtgggcgtcgtcctggcgcaggtgttggcaccactgtttccgatgattgtcgcggtacccgtcggtgcttacctggcgctaccggtggccgcgatcgtcatcggtctgttcgctagtgttgccggattgaagcgcgtggtgacggtcgatcccgcgcaggcgttcggaggtccctag

SEQ ID NO: 157 - protein, 352 aa, Mycobacterium tuberculosis
PLGMLFAALRDMQWRKRRLVITIISTGLIFGMTLVLTGLANGFRVEARHTVDSMGVDVFVVRSGAAGPFLGSIPFPDVDLARVAAEPGVMAAAPLGSVGTIMKEGTSTRNVTVFGAPEHGPGMPRVSEGRSPSKPDEVAASSTMGRHLGDTVEVGARRLRVVGIVPNSTALAKIPNVFLTTEGLQKLAYNGQPNITSIGIIGMPRQLPEGYQTFDRVGAVNDLVRPLKVAVNSISIVAVLLWIVAVLIVGSVVYLSALERLRDFAVFKAIGTPTRSIMAGLALQALVIALLAAVVGVVLAQVLAPLFPMIVAVPVGAYLALPVAAIVIGLFASVAGLKRVVTVDPAQAFGGP

SEQ ID NO: 158 - DNA, 320 bp, Mycobacterium tuberculosis
  CDS (1)..(318)
cgaggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 159 - protein, 106 aa, Mycobacterium tuberculosis
RGRANRRFHGCRRIRGQGRRGRTVPGFDTIRPNRPAPGCSCAWRLGCRPTSDCAVDDPAGHVSAKRHRVRGTRARTRHAAGLGRSGAIDAGRGRGVEHAGPKPRRR

SEQ ID NO: 160 - DNA, 319 bp, Mycobacterium tuberculosis
  CDS (1)..(318)
gaggccgagcgaaccgtcgattccatgggtgtcgacgcattcgtggtcaaggccggcgcggcaggaccgttcctgggttcgacaccattcgcccaaatcgacctgcccgaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 161 - protein, 106 aa, Mycobacterium tuberculosis
EAERTVDSMGVDAFVVKAGAAGPFLGSTPFAQIDLPEVARAPGVLAAAPLATAPSTIRQGTSARNVTAFGAPEHGPGMPRVSDGRAPSTPDEVAVSSTLGRNLGDD

SEQ ID NO: 162 - DNA, 318 bp, Mycobacterium tuberculosis
  CDS (1)..(147)
  CDS (151)..(318)
aggccgagcgaaccgtcgattccatgggtgtcgacgcattcgtggtcaaggccggcgcggcaggaccgttcctgggttcgacaccattcgcccaaatcgacctgccccaggttgctcgtgcgcctggcgtcttggctgccgccccactagcgactgcgccgtcgacgatccggcagggcacgtcagcgcgaaacgtcaccgcgttcggggcaccagagcacggacccggcatgccgcgggtctcggacggtcgggcgccatcgacgccggacgaggtcgcggtgtcgagcacgctgggccgaaacctcggcgacgatc

SEQ ID NO: 163 - protein, 49 aa, Mycobacterium tuberculosis
RPSEPSIPWVSTHSWSRPARQDRSWVRHHSPKSTCPRLLVRLASWLPPH

SEQ ID NO: 164 - protein, 56 aa, Mycobacterium tuberculosis; identical to SEQ ID NO: 147

SEQ ID NO: 165 - DNA, 445 bp, Mycobacterium tuberculosis
  CDS (1)..(249)
  CDS (253)..(279)
  CDS (283)..(444)
ttaacgactcagacggaaacgcttgaaccgcgaggtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 166 - protein, 83 aa, Mycobacterium tuberculosis
LTTQTETLEPRGRSGHQFDSALWQLKVSCEQPGDRIVGLAINRRLADVDNQLTVGTDLDQGSFVTAGLDADDHRVGHRLRLPF

SEQ ID NO: 167 - protein, 9 aa, Mycobacterium tuberculosis
PGAAWAPTT

SEQ ID NO: 168 - protein, 54 aa, Mycobacterium tuberculosis
GTSCLSGPPPPRSPAVCQHVQMTPRSLVRIVGVVVATTLALVSAPAGGRAAHAD

SEQ ID NO: 169 - DNA, 444 bp, Mycobacterium tuberculosis
  CDS (4)..(72)
  CDS (76)..(78)
  CDS (82)..(141)
  CDS (145)..(189)
  CDS (193)..(234)
  CDS (238)..(345)
  CDS (349)..(405)
  CDS (409)..(444)
taacgactcagacggaaacgcttgaaccgcgaggtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgcgacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 170 - protein, 23 aa, Mycobacterium tuberculosis
RLRRKRLNREVAPDTNLTRLFGN

SEQ ID NO: 171 - protein, 20 aa, Mycobacterium tuberculosis
AASSRVTASLALPSIAGSRT

SEQ ID NO: 172 - protein, 15 aa, Mycobacterium tuberculosis
IISSPLGPTSTRGPL

SEQ ID NO: 173 - protein, 14 aa, Mycobacterium tuberculosis
LPGLTRTTTESVIA

SEQ ID NO: 174 - protein, 36 aa, Mycobacterium tuberculosis
GYRSDLGLRGRRRREARHVSAAHRDLGRRQYVSMCR

SEQ ID NO: 175 - protein, 19 aa, Mycobacterium tuberculosis
LHAALFASLVSWLRRPWRW

SEQ ID NO: 176 - protein, 12 aa, Mycobacterium tuberculosis
AHPPAVVPRMRI

SEQ ID NO: 177 - DNA, 443 bp, Mycobacterium tuberculosis
  CDS (1)..(21)
  CDS (25)..(51)
  CDS (55)..(96)
  CDS (100)..(144)
  CDS (148)..(201)
  CDS (205)..(441)
aacgactcagacggaaacgcttgaaccgcgaggtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 178 - protein, 7 aa, Mycobacterium tuberculosis
NDSDGNA

SEQ ID NO: 179 - protein, 9 aa, Mycobacterium tuberculosis
TARSLRTPI

SEQ ID NO: 180 - protein, 14 aa, Mycobacterium tuberculosis
LGSLAIEGELRAAG

SEQ ID NO: 181 - protein, 15 aa, Mycobacterium tuberculosis
PHRWPCHQSPARGRR

SEQ ID NO: 182 - protein, 18 aa, Mycobacterium tuberculosis
SAHRWDRPRPGVLCDCRA

SEQ ID NO: 183 - protein, 79 aa, Mycobacterium tuberculosis
RGRPQSRSSPKATVLTWGCVGADDVRHVMSQRPTATSVAGSMSACADDSTQPCSHRWCRGCDDLGAGERTRRRSCRACG

SEQ ID NO: 184 - DNA, 510 bp, Mycobacterium tuberculosis
  CDS (1)..(30)
  CDS (34)..(66)
  CDS (70)..(114)
  CDS (118)..(510)
cccgaagaggtcccccgttttgttaatttttaaaaaatttgtgtcacaaaccggggtaccaaggcataaaacctagtacctggggcggcggattcaacgaaaaccgagtgggggtagtcaggggcgtgcattccgacgaccctgtacgacccgctggtggcaacgccgatgagtgcgccgacgaaggccgagcgacgggctgccggcgctgaccgccgcggaagccgccgagtgcatggtcaccaccgcccgcacccgaccggtacggatcgcgcctcgggttaccgtcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatc

SEQ ID NO: 185 - protein, 10 aa, Mycobacterium tuberculosis
PEEVPRFVNF

SEQ ID NO: 186 - protein, 11 aa, Mycobacterium tuberculosis
KICVTNRGTKA

SEQ ID NO: 187 - protein, 15 aa, Mycobacterium tuberculosis
NLVPGAADSTKTEWG

SEQ ID NO: 188 - protein, 131 aa, Mycobacterium tuberculosis
SGACIPTTLYDPLVATPMSAPTKAERRAAGADRRGSRRVHGHHRPHPTGTDRASGYRRRQRAGQHRSPLGQCTHAAPQRTAQPLNRVPACRPSAAGVPLRDRHRAMEILASRMLLRPADYQRSLSFYRDQI

SEQ ID NO: 189 - DNA, 509 bp, Mycobacterium tuberculosis
  CDS (1)..(72)
  CDS (76)..(168)
  CDS (172)..(366)
  CDS (370)..(486)
  CDS (490)..(507)
ccgaagaggtcccccgttttgttaatttttaaaaaatttgtgtcacaaagcggggtaccaaggcataaaacctagtacctggggcggcggattcaacgaaaaccgagtgggggtagtcaggggcgtgcattccgacgaccctgtacgacccgctggtggcaacgccgatgagtgcgccgacgaaggccgagcgacgggctgccggcgctgaccgccgcggaagccgccgagtggatggtcaccaccgcccgcacccgaccggtacggatcgcgcctcgggttaccgtcgccgtcaccgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcgcccggcggactatcagcggtcgctgagcttctaccgtgaccagatc

SEQ ID NO: 190 - protein, 24 aa, Mycobacterium tuberculosis
PKRSPVLLIFKKFVSQSGVPRHKT

SEQ ID NO: 191 - protein, 31 aa, Mycobacterium tuberculosis
YLGRRIQRKPSGGSQGRAFRRPCTTRWWQRR

SEQ ID NO: 192 - protein, 65 aa, Mycobacterium tuberculosis
VRRRRPSDGLPALTAAEAAEWMVTTARTRPVRIAPRVTVAVTALDSIGPRWVNALMQRRNEQLNP

SEQ ID NO: 193 - protein, 39 aa, Mycobacterium tuberculosis
TGSRPADPRPPACRYVIDTGPWKSWPAGCYFARRTISGR

SEQ ID NO: 194 - protein, 6 aa, Mycobacterium tuberculosis
ASTVTR

SEQ ID NO: 195 - DNA, 508 bp, Mycobacterium tuberculosis
  CDS (1)..(21)
  CDS (25)..(207)
  CDS (211)..(414)
  CDS (421)..(498)
  CDS (502)..(507)
cgaagaggtcccccgttttgttaatttttaaaaaatttgtgtcacaaagcggggtaccaaggcataaaacctagtacctggggcggcggattcaacgaaaaccgagtgggggtagtcaggggcgtgcattccgacgaccctgtacgacccgctggtggcaacgccgatgagtgcgccgacgaaggccgagcgacgggctgccggcgctgaccgccgcggaagccgccgagtggatggtcaccaccgcccgcacccgaccggtacggatcgcgcctcgggttaccgtcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatc

SEQ ID NO: 196 - protein, 7 aa, Mycobacterium tuberculosis
RRGPPFC

SEQ ID NO: 197 - protein, 61 aa, Mycobacterium tuberculosis
FLKNLCHKAGYQGIKPSTWGGGFNENRVGVVRGVHSDDPVRPAGGNADECADEGRATGCRR

SEQ ID NO: 198 - protein, 68 aa, Mycobacterium tuberculosis
PPRKPPSGWSPPPAPDRYGSRLGLPSPSTRWTASVPAGSMHSCSAATNSSTLEPGPGLPTLGRRRAAT

SEQ ID NO: 199 - protein, 26 aa, Mycobacterium tuberculosis
TQGHGNPGQPDATSAGGLSAVAELLP

SEQ ID NO: 200 - DNA, 225 bp, Mycobacterium tuberculosis
  CDS (1)..(225)
cgtcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatc

SEQ ID NO: 201 - protein, 75 aa, Mycobacterium tuberculosis
RRRQRAGQHRSPLGQCTHAAPQRTAQPLNRVPACRPSAAGVPLRDRHRAMEILASRMLLRPADYQRSLSFYRDQI

SEQ ID NO: 202 - DNA, 224 bp, Mycobacterium tuberculosis
  CDS (1)..(81)
  CDS (85)..(201)
  CDS (205)..(222)
gtcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatc

SEQ ID NO: 203 - protein, 27 aa, Mycobacterium tuberculosis
VAVNALDSIGPRWVNALMQRRNEQLNP

SEQ ID NO: 204 - protein, 39 aa, Mycobacterium tuberculosis
TGSRPADPRPPACRYVIDTGPWKSWPAGCYFGRRTISGR

SEQ ID NO: 205 - protein, 6 aa, Mycobacterium tuberculosis
ASTVTR

SEQ ID NO: 206 - DNA, 223 bp, Mycobacterium tuberculosis
  CDS (1)..(129)
  CDS (136)..(213)
  CDS (217)..(222)
tcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatc

SEQ ID NO: 207 - protein, 43 aa, Mycobacterium tuberculosis
SPSTRWTASVPAGSMHSCSAATNSSTLEPGPGLPTLGRRRAAT

SEQ ID NO: 208 - protein, 26 aa, Mycobacterium tuberculosis
TQGHGNPGQPDATSAGGLSAVAELLP

SEQ ID NO: 209 - DNA, 387 bp, Mycobacterium tuberculosis
  CDS (1)..(384)
atggaaatcctggccagccggatgctacttcggccggcggactatcagcggtcgctgagcttctaccgtgaccagatcgggctggcgattgcccgtgaatacggggccggcacagtgtttttcgccggtcagtcactgctcgaactggccggttacggcgagccggaccattcgcggggaccttttcccggcgcgctgtggctgcaggtgcgcgacctcgaggctacccagaccgagctggtcagccgaggcgtgtcgatcgctcgcgagccccgccgcgaaccgtggggcctgcacgagatgcatgtgaccgacccagacgggatcacactgatattcgtcgaggttcccgagggtcacccgctgcgtacagacacccgggcgtga

SEQ ID NO: 210 - protein, 128 aa, Mycobacterium tuberculosis
MEILASRMLLRPADYQRSLSFYRDQIGLAIAREYGAGTVFFAGQSLLELAGYGEPDHSRGPFPGALWLQVRDLEATQTELVSRGVSIAREPRREPWGLHEMHVTDPDGITLIFVEVPEGHPLRTDTRA

SEQ ID NO: 211 - DNA, 702 bp, Mycobacterium tuberculosis
  CDS (4)..(699)
tagtcagggcgtgcattcgacgacgctgtactacccgctggtggcaactccgatgattgcgccgacgaaggcctacgacgggctgccggcgctgaccgccgcggaagccgccgagtggatggtcaccgccgcccgcacccgaccggtgcggatcgcgcctcgggttgccgtcgccgtcaacgcgctggacagcatcggtccccgctgggtcaatgcactcatgcagcgccgcaacgaacagctcaacccttgaaccgggtcccggcctgccgaccctcggccgccggcgtgccgctacgtgatagacacagggccatggaaatcctggccagccggatgctacttcggccggcggactatcagcggtcgctgagcttctaccgtgaccagatcgggctggcgattgcccgtgaatacggggccggcacagtgtttttcgccggtcagtcactgctcgaactggccggttacggcgagccggaccattcgcggggaccttttcccggcgcgctgtggctgcaggtgcgcgacctcgaggctacccagaccgagctggtcagccgaggcgtgtcgatcgctcgcgagccccgccgcgaaccgtggggcctgcacgagatgcatgtgaccgacccagacgggatcacactgatattcgtcgaggttcccgagggtcacccgctgcgtacagacacccgggcgtga

SEQ ID NO: 212 - protein, 232 aa, Mycobacterium tuberculosis
SGRAFDDAVLPAGGNSDDCADEGLRRAAGADRRGSRRVDGHRRPHPTGADRASGCRRRQRAGQHRSPLGQCTHAAPQRTAQPLNRVPACRPSAAGVPLRDRHRAMEILASRMLLRPADYQRSLSFYRDQIGLAIAREYGAGTVFFAGQSLLELAGYGEPDHSRGPFPGALWLQVRDLEATQTELVSRGVSIAREPRREPWGLHEMHVTDPDGITLIFVEVPEGHPLRTDTRA

SEQ ID NO: 213 - DNA, 316 bp, Mycobacterium tuberculosis
  CDS (1)..(87)
  CDS (94)..(213)
  CDS (217)..(315)
gaccgaagggatttcgcgactaactcggcctgtaaggcaacgcgaggtcttcatgccgaggacgtagacaggaagagacagggaagctgatgacgtcgcgtaccggaccgccattctgtcgagtctttccgagttcagcaacaatcgacacagaagcggggaccagaccgggaggacgacgcggcccgggccgcttcgggccgagtgtctgagtaagaccagagtcacgggtccgtgtgtgacaaccgcgcggaattcaatcggatggcgggcgggaccggattgcgccggtcaccgaggaacctccggagtgatc

SEQ ID NO: 214 - protein, 29 aa, Mycobacterium tuberculosis
DRRDFATNSACKATRGLHAEDVDRKRQGS

SEQ ID NO: 215 - protein, 40 aa, Mycobacterium tuberculosis
RRVPDRHSVESFRVQQQSTQKRGPDREDDAARAASGRVSE

SEQ ID NO: 216 - protein, 33 aa, Mycobacterium tuberculosis
DQSHGSVCDNRAEFNRMAGGTGLRRSPRNLRSD

SEQ ID NO: 217 - DNA, 315 bp, Mycobacterium tuberculosis
  CDS (1)..(63)
  CDS (67)..(315)
accgaagggatttcgcgactaactcggcctgtaaggcaacgcgaggtcttcatgccgaggacgtagacaggaagagacagggaagctgatgacgtcgcgtaccggaccgccattctgtcgagtctttccgagttcagcaacaatcgacacagaagcggggaccagaccgggaggacgacgcggcccgggccgcttcgggccgagtgtctgagtaagaccagagtcacgggtccgtgtgtgacaaccgcgcggaattcaatcggatggcgggcgggaccggattgcgccggtcaccgaggaacctccggagtgatc

SEQ ID NO: 218 - protein, 21 aa, Mycobacterium tuberculosis
TEGISRLTRPVRQREVFMPRT

SEQ ID NO: 219 - protein, 83 aa, Mycobacterium tuberculosis
TGRDREADDVAYRTAILSSLSEFSNNRHRSGDQTGRTTRPGPLRAECLSKTRVTGPCVTTARNSIGWRAGPDCAGHRGTSGVI

SEQ ID NO: 220 - DNA, 314 bp, Mycobacterium tuberculosis
  CDS (1)..(18)
  CDS (22)..(30)
  CDS (34)..(207)
  CDS (211)..(237)
  CDS (241)..(309)
ccgaagggatttcgcgactaactcggcctgtaaggcaacgcgaggtcttcatgccgaggacgtagacaggaagagacagggaagctgatgacgtcgcgtaccggaccgccattctgtcgagtctttccgagttcagcaacaatcgacacagaagcggggaccagaccgggaggacgacgcggcccgggccgcttcgggccgagtgtctgagtaagaccagagtcacgggtccgtgtgtgacaaccgcgcggaattcaatcggatggcgggcgggaccggattgcgccggtcaccgaggaacctccggagtgatc

SEQ ID NO: 221 - protein, 6 aa, Mycobacterium tuberculosis
PKGFRD

SEQ ID NO: 222 - protein, 58 aa, Mycobacterium tuberculosis
GNARSSCRGRRQEETGKLMTSRTGPPFCRVFPSSATIDTEAGTRPGGRRGPGRFGPSV

SEQ ID NO: 223 - protein, 9 aa, Mycobacterium tuberculosis
VRPESRVRV

SEQ ID NO: 224 - protein, 23 aa, Mycobacterium tuberculosis
QPRGIQSDGGRDRIAPVTEEPPE

SEQ ID NO: 225 - DNA, 703 bp, Mycobacterium tuberculosis
  CDS (1)..(48)
  CDS (52)..(102)
  CDS (106)..(507)
  CDS (511)..(537)
  CDS (541)..(702)
gggatttcgttgcccgatggattgtttgtacggtttgggaaaaacacttgaagtcctttttattggcaatgctggaaatggacattccaatattgcgcgaattaaccgaacacggtgaggggggggcaagcgtttgtaccggggccagcaagcgccgccgaccggttgaccgaagccagcatgttgttgtgtcagcgcgggcttggtctcgatgtcccggccttggctggacccgcttcttcaaaacaggttgaacttaacgactcaagaacggaaacgcttgaaccgcgacgtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 226 - protein, 16 aa, Mycobacterium tuberculosis
GISLPDGLFVRFGKNT

SEQ ID NO: 227 - protein, 17 aa, Mycobacterium tuberculosis
SPFYWQCWKWTFQYCAN

SEQ ID NO: 228 - DNA, 702 bp, Mycobacterium tuberculosis
  CDS (1)..(114)
  CDS (118)..(165)
  CDS (169)..(330)
  CDS (334)..(336)
  CDS (340)..(399)
  CDS (403)..(447)
  CDS (451)..(492)
  CDS (496)..(503)
  CDS (507)..(663)
  CDS (667)..(702)
ggatttcgttgcccgatggattgtttgtacggtttgggaaaaacacttgaagtcctttttattggcaatgctggaaatggacattccaatattgcgcgaattaaccgaacacggtgaggggggggcaagcgtttgtaccggggccagcaagcgccgccgaccggttgaccgaagccagcatgttgttgtgtcagcgcgggcttggtctcgatgtcccggccttggctggacccgcttcttcaaaacaggttgaacttaacgactcaagaacggaaacgcttgaaccgcgacgtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 229 - protein, 38 aa, Mycobacterium tuberculosis
GFRCPMDCLYGLGKTLEVLFIGNAGNGHSNIARINRTR

SEQ ID NO: 230 - protein, 16 aa, Mycobacterium tuberculosis
GGGKRLYRGQQAPPTG

SEQ ID NO: 231 - protein, 54 aa, Mycobacterium tuberculosis
PKPACCCVSAGLVSMSRPWLDPLLQNRLNLTTQERKRLNRDVAPDTNLTRLFGN

SEQ ID NO: 232 - protein, 20 aa, Mycobacterium tuberculosis
AASSRVTASLALPSIAGSRT

SEQ ID NO: 233 - protein, 15 aa, Mycobacterium tuberculosis
IISSPLGPTSTRGPL

SEQ ID NO: 234 - protein, 14 aa, Mycobacterium tuberculosis
LPGLTRTTTESVIA

SEQ ID NO: 235 - protein, 36 aa, Mycobacterium tuberculosis
GYRSDLGLRGRRRREARHVSAAHRHLGRRQYVSMCR

SEQ ID NO: 236 - protein, 19 aa, Mycobacterium tuberculosis
LHAALFASLVSWLRRPWRW

SEQ ID NO: 237 - protein, 12 aa, Mycobacterium tuberculosis
AHPPAVVPRMRI

SEQ ID NO: 238 - DNA, 701 bp, Mycobacterium tuberculosis
  CDS (1)..(249)
  CDS (253)..(255)
  CDS (259)..(279)
  CDS (283)..(309)
  CDS (313)..(354)
  CDS (358)..(402)
  CDS (406)..(459)
  CDS (463)..(699)
gatttcgttgcccgatggattgtttgtacggtttgggaaaaacacttgaagtcctttttattggcaatgctggaaatggacattccaatattgcgcgaattaaccgaacacggtgaggggggggcaagcgtttgtaccggggccagcaagcgccgccgaccggttgaccgaagccagcatgttgttgtgtcagcgcgggcttggtctcgatgtcccggccttggctggacccgcttcttcaaaacaggttgaacttaacgactcaagaacggaaacgcttgaaccgcgacgtcgctccggacaccaatttgactcggctctttggcaattgaaggtgagctgcgagcagccgggtgaccgcatcgttggccttgccatcaatcgccggctcgcggacgtagataatcagctcaccgttgggaccgacctcgaccaggggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 239 - protein, 83 aa, Mycobacterium tuberculosis
DFVARWIVCTVWEKHLKSFLLAMLEMDIPILRELTEHGEGGASVCTGASKRRRPVDRSQHVVVSARAWSRCPGLGWTRFFKTG

SEQ ID NO: 240 - protein, 7 aa, Mycobacterium tuberculosis
RLKNGNA

SEQ ID NO: 241 - protein, 9 aa, Mycobacterium tuberculosis
TATSLRTPI

SEQ ID NO: 242 - protein, 14 aa, Mycobacterium tuberculosis
LGSLAIEGELRAAG

SEQ ID NO: 243 - protein, 15 aa, Mycobacterium tuberculosis
PHRWPCHQSPARGRR

SEQ ID NO: 244 - protein, 18 aa, Mycobacterium tuberculosis
SAHRWDRPRPGVLCDCRA

SEQ ID NO: 245 - protein, 79 aa, Mycobacterium tuberculosis; identical to SEQ ID NO: 183

SEQ ID NO: 246 - DNA, 265 bp, Mycobacterium tuberculosis
  CDS (1)..(69)
  CDS (73)..(99)
  CDS (103)..(264)
gggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 247 - protein, 23 aa, Mycobacterium tuberculosis
GSFVTAGLDADDHRVGHRLRLPF

SEQ ID NO: 248 - protein, 9 aa, Mycobacterium tuberculosis
PGAAWAPTT

SEQ ID NO: 249 - protein, 54 aa, Mycobacterium tuberculosis; identical to SEQ ID NO: 168

SEQ ID NO: 250 - DNA, 264 bp, Mycobacterium tuberculosis
  CDS (1)..(9)
  CDS (13)..(54)
  CDS (58)..(165)
  CDS (169)..(225)
  CDS (229)..(264)
ggtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 251 - protein, 14 aa, Mycobacterium tuberculosis
LPGLTRTTTESVIA

SEQ ID NO: 252 - protein, 36 aa, Mycobacterium tuberculosis; identical to SEQ ID NO: 235

SEQ ID NO: 253 - protein, 19 aa, Mycobacterium tuberculosis
LHAALFASLVSWLRRPWRW

SEQ ID NO: 254 - protein, 12 aa, Mycobacterium tuberculosis
AHPPAVVPRMRI

SEQ ID NO: 255 - DNA, 263 bp, Mycobacterium tuberculosis
  CDS (1)..(21)
  CDS (25)..(261)
gtcctttgtgactgccgggcttgacgcggacgaccacagagtcggtcatcgcctaaggctaccgttctgacctggggctgcgtgggcgccgacgacgtgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatc

SEQ ID NO: 256 - protein, 7 aa, Mycobacterium tuberculosis
VLCDCRA

SEQ ID NO: 257 - protein, 79 aa, Mycobacterium tuberculosis; identical to SEQ ID NO: 183

SEQ ID NO: 258 - DNA, 654 bp, Mycobacterium tuberculosis
  CDS (1)..(651)
atgactccacgcagccttgttcgcatcgttggtgtcgtggttgcgacgaccttggcgctggtgagcgcacccgccggcggtcgtgccgcgcatgcggatccgtgttcggacatcgcggtcgttttcgctcgcggcacgcatcaggcttctggtcttggcgacgtcggtgaggcgttcgtcgactcgcttacctcgcaagttggcgggcggtcgattggggtctacgcggtgaactacccagcaagcgacgactaccgcgcgagcgcgtcaaacggttccgatgatgcgagcgcccacatccagcgcaccgtcgccagctgcccgaacaccaggattgtgcttggtggctattcgcagggtgcgacggtcatcgatttgtccacctcggcgatgccgcccgcggtggcagatcatgtcgccgctgtcgcccttttcggcgagccatccagtggtttctccagcatgttgtggggcggcgggtcgttgccgacaatcggtccgctgtatagctctaagaccataaacttgtgtgctcccgacgatccaatatgcaccggaggcggcaatattatggcgcatgtttcgtatgttcagtcggggatgacaagccaggcggcgacattcgcggcgaacaggctcgatcacgccggatga

SEQ ID NO: 259 - protein, 217 aa, Mycobacterium tuberculosis
MTPRSLVRIVGVVVATTLALVSAPAGGRAAHADPCSDIAVVFARGTHQASGLGDVGEAFVDSLTSQVGGRSIGVYAVNYPASDDYRASASNGSDDASAHIQRTVASCPNTRIVLGGYSQGATVIDLSTSAMPPAVADHVAAVALFGEPSSGFSSMLWGGGSLPTIGPLYSSKTINLCAPDDPICTGGGNIMAHVSYVQSGMTSQAATFAANRLDHAG

SEQ ID NO: 260 - DNA, 720 bp, Mycobacterium tuberculosis
  CDS (4)..(717)
tgaggcacgtcatgtctcagcggcccaccgccacctcggtcgccggcagtatgtcagcatgtgcagatgactccacgcagccttgttcgcatcgttggtgtcgtggttgcgacgaccttggcgctggtgagcgcacccgccggcggtcgtgccgcgcatgcggatccgtgttcggacatcgcggtcgttttcgctcgcggcacgcatcaggcttctggtcttggcgacgtcggtgaggcgttcgtcgactcgcttacctcgcaagttggcgggcggtcgattggggtctacgcggtgaactacccagcaagcgacgactaccgcgcgagcgcgtcaaacggttccgatgatgcgagcgcccacatccagcgcaccgtcgccagctgcccgaacaccaggattgtgcttggtggctattcgcagggtgcgacggtcatcgatttgtccacctcggcgatgccgcccgcggtggcagatcatgtcgccgctgtcgcccttttcggcgagccatccagtggtttctccagcatgttgtggggcggcgggtcgttgccgacaatcggtccgctgtatagctctaagaccataaacttgtgtgctcccgacgatccaatatgcaccggaggcggcaatattatggcgcatgtttcgtatgttcagtcggggatgacaagccaggcggcgacattcgcggcgaacaggctcgatcacgccggatga

SEQ ID NO: 261 - protein, 238 aa, Mycobacterium tuberculosis
GTSCLSGPPPPRSPAVCQHVQMTPRSLVRIVGVVVATTLALVSAPAGGRAAHADPCSDIAVVFARGTHQASGLGDVGEAFVDSLTSQVGGRSIGVYAVNYPASDDYRASASNGSDDASAHIQRTVASCPNTRIVLGGYSQGATVIDLSTSAMPPAVADHVAAVALFGEPSSGFSSMLWGGGSLPTIGPLYSSKTINLCAPDDPICTGGGNIMAHVSYVQSGMTSQAATFAANRLDHAG

SEQ ID NO: 262 - DNA, 361 bp, Mycobacterium tuberculosis
  CDS (1)..(96)
  CDS (100)..(165)
  CDS (169)..(198)
  CDS (202)..(306)
  CDS (310)..(312)
  CDS (316)..(360)
ccaccggggctggaggggcgaatgtgcgccgaacgccgtcggccaacttggccgctgagggcggctgatcccctggcccgagacggggcaagccaatagcggctccatcgggctttgctggtagcggttcggcgggaaccgagcgccgacgttgtcggtgcccggtgatatattgggtcagacgggtatggcggcgactgaggtgatctgcgacacgccgccgcggtgctcgagccaggcttacgaccagggaatttcgaaaatgttattcagaacatcttgtatctcttcctccgtgccaccccctaggtgtagtgttttcgagtaccggcagatcccagttcaccagtctcaccagatc

SEQ ID NO: 263 - protein, 32 aa, Mycobacterium tuberculosis
PPGLEGRMCAERRRPTWPLRAADPLARDGASQ

SEQ ID NO: 264 - protein, 22 aa, Mycobacterium tuberculosis
RLHRALLVAVRREPSADVVGAR

SEQ ID NO: 265 - protein, 10 aa, Mycobacterium tuberculosis
YIGSDGYGGD

SEQ ID NO: 266 - protein, 35 aa, Mycobacterium tuberculosis
GDLRHAAAVLEPGLRPGNFENVIQNILYLFLRATP

SEQ ID NO: 267 - protein, 15 aa, Mycobacterium tuberculosis
CFRVPADPSSPVSPD

SEQ ID NO: 268 - DNA, 360 bp, Mycobacterium tuberculosis
  CDS (1)..(54)
  CDS (58)..(120)
  CDS (124)..(360)
caccggggctggaggggcgaatgtgcgccgaacgccgtcggccaacttggccgctgagggcggctgatcccctggcccgagacggggcaagccaatagcggctccatcgggctttgctggtagcggttcggcgggaaccgagcgccgacgttgtcggtgcccggtgatatattgggtcagacgggtatggcggcgactgaggtgatctgcgacacgccgccgcggtgctcgagccaggcttacgaccagggaatttcgaaaatgttattcagaacatcttgtatctcttcctccgtgccaccccctaggtgtagtgttttcgagtaccggcagatcccagttcaccagtctcaccagatc

SEQ ID NO: 269 - protein, 18 aa, Mycobacterium tuberculosis
HRGWRGECAPNAVGQLGR

SEQ ID NO: 270 - protein, 21 aa, Mycobacterium tuberculosis
GRLIPWPETGQANSGSIGLCW

SEQ ID NO: 271 - protein, 79 aa, Mycobacterium tuberculosis
RFGGNRAPTLSVPGDILGQTGMAATEVICDTPPRCSSQAYDQGISKMLFRTSCISSSVPPPRCSVFEYRQIPVHQSHQI

SEQ ID NO: 272 - protein, 54 aa, Mycobacterium tuberculosis
TGFGSRPSEPSIPWVSTHSWSRPARQDRSWVRHHSPKSTCPRLLVRLASWLPPH

SEQ ID NO: 273 - protein, 56 aa, Mycobacterium tuberculosis; identical to SEQ ID NO: 147

SEQ ID NO: 274 - DNA, 359 bp, Mycobacterium tuberculosis
  CDS (1)..(63)
  CDS (67)..(201)
  CDS (205)..(357)
accggggctggaggggcgaatgtgcgccgaacgccgtcggccaacttggccgctgagggcggctgatcccctggcccgagacggggcaagccaatagcggctccatcgggctttgctggtagcggttcggcgggaaccgagcgccgacgttgtcggtgcccggtgatatattgggtcagacgggtatggcggcgactgaggtgatctgcgacacgccgccgcggtgctcgagccaggcttacgaccagggaatttcgaaaatgttattcagaacatcttgtatctcttcctccgtgccaccccctaggtgtagtgttttcgagtaccggcagatcccagttcaccagtctcaccagatc

SEQ ID NO: 275 - protein, 21 aa, Mycobacterium tuberculosis
TGAGGANVRRTPSANLAAEGG

SEQ ID NO: 276 - protein, 45 aa, Mycobacterium tuberculosis
SPGPRRGKPIAAPSGFAGSGSAGTERRRCRCPVIYWVRRVWRRLR

SEQ ID NO: 277 - protein, 51 aa, Mycobacterium tuberculosis
SATRRRGARARLTTREFRKCYSEHLVSLPPCHPLGVVFSSTGRSQFTSLTR

SEQ ID NO: 278 - DNA, 46 bp, Mycobacterium tuberculosis
  CDS (1)..(45)
ttttcgagtaccggcagatcccaggttcaccaggtctcaccagatc

SEQ ID NO: 279 - protein, 15 aa, Mycobacterium tuberculosis
FSSTGRSQVHQVSPD

SEQ ID NO: 280 - DNA, 48 bp, Mycobacterium tuberculosis
  CDS (1)..(48)
tgttttcgagtaccggcagatcccaggttcaccaggtctcaccagatc

SEQ ID NO: 281 - protein, 16 aa, Mycobacterium tuberculosis
CFRVPADPRFTRSHQI

SEQ ID NO: 282 - DNA, 47 bp, Mycobacterium tuberculosis
  CDS (1)..(45)
gttttcgagtaccggcagatcccaggttcaccaggtctcaccagatc

SEQ ID NO: 283 - protein, 15 aa, Mycobacterium tuberculosis
VFEYRQIPGSPGLTR

SEQ ID NO: 284 - DNA, 435 bp, Mycobacterium tuberculosis
  CDS (4)..(432)
tagcggttcggcgggaagctagcggcgacgttgtcggtggccggtgatatattgggtcagacgggtatggcggcggctgaggtgatctgcgacacgccgccgcggtgctcgagccaggcttacgaccagggaatttcgaaaatgttattcagaacatcttgtatctcttctccgtgccaccccctaggtgtagtgttttcgagtaccggcagatcccaggttcaccaggtctcaccagatccacggggcgcgatgaacttcccggcatcggcatcgccaggtcgacggacgtggtcgcgctatgacgggaatctggagccttgtcgggccgctcaacatatcgaagatgcactacttgagtcgttgccagatcctgtcagattcccgatttccgcaaaggagcggtacgcccatgaccgtgaccgtttacactaa

SEQ ID NO: 285 - protein, 143 aa, Mycobacterium tuberculosis
RFGGKLAATLSVAGDILGQTGMAAAEVICDTPPRCSSQAYDQGISKMLFRTSCISSPCHPLGVVFSSTGRSQVHQVSPDPRGAMNFPASASPGRRTWSRYDGNLEPCRAAQHIEDALLESLPDPVRFPISAKERYAHDRDRLH

SEQ ID NO: 286 - DNA, 555 bp, Mycobacterium tuberculosis
  CDS (1)..(552)
gtgtcagataccaagtccgacatcaaaatcttggccttagtgggaagcctgcgcgcggcgtcgttcaaccgccagatcgccgagctggctgccaaggtcgctccggacggcgtcaccgtcaccatgttcgaggggctgggggacctgccgttctacaacgaagacatcgacacagcgacggaggtgccggcgccggtgagcgcgttgcgggaggccgcgtctgacgcgcacgctgccttggtggtcacgccggaatacaacggcagcattccggccgtgatcaagaacgcgatcgactggctgtccaggccattcggcgatggcgcgttgaaggacaagccgttggccgtgatcggcggctccatgggccgctacggcggggtatgggcgcacgacgagactcgcaagtcgttcagcatcgctggcacgcgggtggtcgatgcgatcaaactgtcggtgccgttccaaactctgggcaagtcggtcgcggacgacgccgggctggcggcgaatgtgcgcgacgccgtcggcaacttggccgctgaggtcggctga

SEQ ID NO: 287 - protein, 184 aa, Mycobacterium tuberculosis
VSDTKSDIKILALVGSLRAASFNRQIAELAAKVAPDGVTVTMFEGLGDLPFYNEDIDTATEVPAPVSALREAASDAHAALVVTPEYNGSIPAVIKNAIDWLSRPFGDGALKDKPLAVIGGSMGRYGGVWAHDETRKSFSIAGTRVVDAIKLSVPFQTLGKSVADDAGLAANVRDAVGNLAAEVG

SEQ ID NO: 288 - DNA, 636 bp, Mycobacterium tuberculosis
  CDS (4)..(633)
taacgcgatcggaataaatcggaccatggtccggttggctcgtgcaaggacgtggaccaacaagcggaaaggaacgtagcagtgtcagataccaagtccgacatcaaaatcttggccttagtgggaagcctgcgcgcggcgtcgttcaaccgccagatcgccgagctggctgccaaggtcgctccggacggcgtcaccgtcaccatgttcgaggggctgggggacctgccgttctacaacgaagacatcgacacagcgacggaggtgccggcgccggtgagcgcgttgcgggaggccgcgtctgacgcgcacgctgccttggtggtcacgccggaatacaacggcagcattccggccgtgatcaagaacgcgatcgactggctgtccaggccattcggcgatggcgcgttgaaggacaagccgttggccgtgatcggcggctccatgggccgctacggcggggtatgggcgcacgacgagactcgcaagtcgttcagcatcgctggcacgcgggtggtcgatgcgatcaaactgtcggtgccgttccaaactctgggcaagtcggtcgcggacgacgccgggctggcggcgaatgtgcgcgacgccgtcggcaacttggccgctgaggtcggctga

SEQ ID NO: 289 - protein, 210 aa, Mycobacterium tuberculosis
RDRNKSDHGPVGSCKDVDQQAERNVAVSDTKSDIKILALVGSLRAASFNRQIAELAAKVAPDGVTVTMFEGLGDLPFYNEDIDTATEVPAPVSALREAASDAHAALVVTPEYNGSIPAVIKNAIDWLSRPFGDGALKDKPLAVIGGSMGRYGGVWAHDETRKSFSIAGTRVVDAIKLSVPFQTLGKSVADDAGLAANVRDAVGNLAAEVG

SEQ ID NO: 290 - DNA, 1121 bp, Mycobacterium tuberculosis
  CDS (4)..(705)
  CDS (709)..(768)
  CDS (772)..(870)
  CDS (874)..(876)
  CDS (880)..(939)
  CDS (943)..(1119)
taacgcgatcggaataaatcggaccatggtccggttggctcgtgcaaggacgtggaccaacaagcggaaaggaacgtagcagtgtcagataccaagtccgacatcaaaatcttggccttagtgggaagcctgcgcgcggcgtcgttcaaccgccagatcgccgagctggctgccaaggtcgctccggacggcgtcaccgtcaccatgttcgaggggctgggggacctgccgttctacaacgaagacatcgacacagcgacggaggtgccggcgccggtgagcgcgttgcgggaggccgcgtctgacgcgcacgctgccttggtggtcacgccggaatacaacggcagcattccggccgtgatcaagaacgcgatcgactggctgtccaggccattcggcgatggcgcgttgaaggacaagccgttggccgtgatcggcggctccatgggccgctacggcggggtatgggcgcacgacgagactcgcaagtcgttcagcatcgctggcacgcgggtggtcgatgcgatcaaactgtcggtgccgttccaaactctgggcaagtcggtcgcggacgacgccgggctggcggcgaatgtgcgcgacgccgtcggcaacttggccgctgaggtcggctgatccctgggccgaggcgggtcagccaatagcggctccatcggctttgctggtagcggttcggcgggaagctagcggcgacgttgtcggtggccggtgatatattgggtcagacgggtatggcggcggctgaggtgatctgcgacacgccgccgcggtgctcgagccaggcttacgaccagggaatttcgaaaatgttattcagaacatcttgtatctcttctccgtgccaccccctaggtgtagtgttttcgagtaccggcagatcccaggttcaccaggtctcaccagatccacggggcgcgatgaacttcccggcatcggcatcgccaggtcgacggacgtggtcgcgctatgacgggaatctggagccttgtcgggccgctcaacatatcgaagatgcactacttgagtcgttgccagatcctgtcagattcccgatttccgcaaaggagcggtacgcccatgaccgtgaccgtttacactaa

SEQ ID NO: 291 - protein, 210 aa, Mycobacterium tuberculosis; identical to SEQ ID NO: 289

SEQ ID NO: 292 - protein, 23 aa, Mycobacterium tuberculosis
SLGRGGSANSGSIGFAGSGSAGS

SEQ ID NO: 293 - protein, 20 aa, Mycobacterium tuberculosis
RRRCRWPVIYWVRRVWRRLR

SEQ ID NO: 294 - protein, 33 aa, Mycobacterium tuberculosis; identical to SEQ ID NO: 126

SEQ ID NO: 295 - protein, 20 aa, Mycobacterium tuberculosis
CFRVPADPRFTRSHQIHGAR

SEQ ID NO: 296 - protein, 59 aa, Mycobacterium tuberculosis
TSRHRHRQVDGRGRAMTGIWSLVGPLNISKMHYLSRCQILSDSRFPQRSGTPMTVTVYT

SEQ ID NO: 297 - DNA, 1121 bp, Mycobacterium tuberculosis; identical to SEQ ID NO: 290
  CDS (2)..(76)
  CDS (80)..(118)
  CDS (122)..(277)
  CDS (281)..(358)
  CDS (362)..(409)
  CDS (413)..(730)
  CDS (734)..(763)
  CDS (767)..(988)
  CDS (992)..(1042)
  CDS (1046)..(1099)
  CDS (1103)..(1105)
  CDS (1108)..(1120)

SEQ ID NO: 298 - protein, 25 aa, Mycobacterium tuberculosis
NAIGINRTMVRLARARTWTNKRKGT

SEQ ID NO: 299 - protein, 13 aa, Mycobacterium tuberculosis
QCQIPSPTSKSWP

SEQ ID NO: 300 - protein, 52 aa, Mycobacterium tuberculosis
WEACARRRSTARSPSWLPRSLRTASPSPCSRGWGTCRSTTKTSTQRRRCRRR

SEQ ID NO: 301 - protein, 26 aa, Mycobacterium tuberculosis
ARCGRPRLTRTLPWWSRRNTTAAFRP

SEQ ID NO: 302 - protein, 16 aa, Mycobacterium tuberculosis
SRTRSTGCPGHSAMAR

SEQ ID NO: 303 - protein, 6 aa, Mycobacterium tuberculosis
RTSRWP

SEQ ID NO: 304 - protein, 99 aa, Mycobacterium tuberculosis
SAAPWAATAGYGRTTRLASRSASLARGWSMRSNCRCRSKLWASRSRTTPGWRRMCATPSATWPLRSADPWAEAGQPIAAPSALLVAVRREASGDVVGGR

SEQ ID NO: 305 - protein, 10 aa, Mycobacterium tuberculosis
YIGSDGYGGG

SEQ ID NO: 306 - protein, 74 aa, Mycobacterium tuberculosis
GDLRHAAAVLEPGLRPGNFENVIQNILYLFSVPPPRCSVFEYRQIPGSPGLTRSTGRDELPGIGIARSTDVVAL

SEQ ID NO: 307 - protein, 17 aa, Mycobacterium tuberculosis
RESGALSGRSTYRRCTT

SEQ ID NO: 308 - protein, 18 aa, Mycobacterium tuberculosis
VVARSCQIPDFRKGAVRP

SEQ ID NO: 309 - protein, 4 aa, Mycobacterium tuberculosis
PFTL

SEQ ID NO: 310 - DNA, 1121 bp, Mycobacterium tuberculosis; identical to SEQ ID NO: 290
  CDS (3)..(14)
  CDS (18)..(302)
  CDS (306)..(623)
  CDS (627)..(662)
  CDS (666)..(686)
  CDS (690)..(1118)

SEQ ID NO: 311 - protein, 4 aa, Mycobacterium tuberculosis
TRSE

SEQ ID NO: 312 - protein, 95 aa, Mycobacterium tuberculosis
IGPWSGWLVQGRGPTSGKERSSVRYQVRHQNLGLSGKPARGVVQPPDRRAGCQGRSGRRHRHHVRGAGGPAVLQRRHRHSDGGAGAGERVAGGRV

SEQ ID NO: 313 - protein, 106 aa, Mycobacterium tuberculosis
RARCLGGHAGIQRQHSGRDQERDRLAVQAIRRWRVEGQAVGRDRRLHGPLRRGMGARRDSQVVQHRWHAGGRCDQTVGAVPNSGQVGRGRRRAGGECARRRRQLGR

SEQ ID NO: 314 - protein, 12 aa, Mycobacterium tuberculosis
GRLIPGPRRVSQ

SEQ ID NO: 315 - protein, 7 aa, Mycobacterium tuberculosis
RLHRLCW

SEQ ID NO: 316 - protein, 143 aa, Mycobacterium tuberculosis; identical to SEQ ID NO: 285

SEQ ID NO: 317 - DNA, 300 bp, Mycobacterium tuberculosis
  CDS (1)..(150)
  CDS (154)..(243)
  CDS (247)..(300)
caagcccggccgcgactgtttgccgttttggggctcctaccagaacaccacctggcggccgcgcaccatggtgtgcaccagttgcgatcggttcctcccgcgcgcgggcggcgacgacgtcgatgcccgcgccccggcggcgcagctgcgtagctcgacccggtcgacgacgacggggtcggcggaccagtcggcgatgtcgaggcgatggcaatacagcgccttggtgcgcggccacacgtctgaggtggcgaagaccagtcccgcgcccaccggcagccggatccggatacgcggtac

SEQ ID NO: 318 - protein, 50 aa, Mycobacterium tuberculosis
QARPRLFAVLGLLPEHHLAAAHHGVHQLRSVPPARGRRRRRCPRPGGAAA

SEQ ID NO: 319 - protein, 30 aa, Mycobacterium tuberculosis
LDPVDDDGVGGPVGDVEAMAIQRLGARPHV

SEQ ID NO: 320 - protein, 18 aa, Mycobacterium tuberculosis
GGEDQSRAHRQPDPDTRY

SEQ ID NO: 321 - DNA, 299 bp, Mycobacterium tuberculosis
  CDS (1)..(297)
aagcccggccgcgactgtttgccgttttggggctcctaccagaacaccacctggcggccgcgcaccatggtgtgcaccagttgcgatcggttcctcccgcgcgcgggcggcgacgacgtcgatgcccgcgccccggcggcgcagctgcgtagctcgacccggtcgacgacgacggggtcggcggaccagtcggcgatgtcgaggcgatggcaatacagcgccttggtgcgcggccacacgtctgaggtggcgaagaccagtcccgcgcccaccggcagccggatccggatacgcggtac

SEQ ID NO: 322 - protein, 99 aa, Mycobacterium tuberculosis
KPGRDCLPFWGSYQNTTWRPRTMVCTSCDRFLPRAGGDDVDARAPAAQLRSSTRSTTTGSADQSAMSRRWQYSALVRGHTSEVAKTSPAPTGSRIRIRG

SEQ ID NO: 323 - DNA, 298 bp, Mycobacterium tuberculosis
  CDS (1)..(297)
agcccggccgcgactgtttgccgttttggggctcctaccagaacaccacctggcggccgcgcaccatggtgtgcaccagttgcgatcggttcctcccgcgcgcgggcggcgacgacgtcgatgcccgcgccccggcggcgcagctgcgtagctcgacccggtcgacgacgacggggtcggcggaccagtcggcgatgtcgaggcgatggcaatacagcgccttggtgcgcggccacacgtctgaggtggcgaagaccagtcccgcgcccaccggcagccggatccggatacgcggtac

SEQ ID NO: 324 - protein, 99 aa, Mycobacterium tuberculosis
SPAATVCRFGAPTRTPPGGRAPWCAPVAIGSSRARAATTSMPAPRRRSCVARPGRRRRGRRTSRRCRGDGNTAPWCAATRLRWRRPVPRPPAAGSGYAV

SEQ ID NO: 325 - DNA, 233 bp, Mycobacterium tuberculosis
  CDS (1)..(231)
ggcggccgcgcgccatggtgtgcaccagttgcgatcggttctcccgcgcgcgggcggcgacgacgtcgatggccgcgccccggcggctgcagctgcgtagctcgacccggtcgacgacgacggggtcggcgggccagtcggcgatgtcgaggcgatggcaatacagcgccttggtgcgcggccacacgtctgaggtggcgaagaccagtcccgcgcccaccggcagccggatc

SEQ ID NO: 326 - protein, 77 aa, Mycobacterium tuberculosis
GGRAPWCAPVAIGSPARGRRRRRWPRPGGCSCVARPGRRRRGRRASRRCRGDGNTAPWCAATRLRWRRPVPRPPAAG

SEQ ID NO: 327 - DNA, 232 bp, Mycobacterium tuberculosis
  CDS (1)..(96)
  CDS (100)..(189)
  CDS (193)..(231)
gcggccgcgcgccatggtgtgcaccagttgcgatcggttctcccgcgcgcgggcggcgacgacgtcgatggccgcgccccggcggctgcagctgcgtagctcgacccggtcgacgacgacggggtcggcgggccagtcggcgatgtcgaggcgatggcaatacagcgccttggtgcgcggccacacgtctgaggtggcgaagaccagtcccgcgcccaccggcagccggatc

SEQ ID NO: 328 - protein, 32 aa, Mycobacterium tuberculosis
AAARHGVHQLRSVLPRAGGDDVDGRAPAAAAA

SEQ ID NO: 329 - protein, 30 aa, Mycobacterium tuberculosis; identical to SEQ ID NO: 319

SEQ ID NO: 330 - protein, 13 aa, Mycobacterium tuberculosis
GGEDQSRAHRQPD

SEQ ID NO: 331 - DNA, 234 bp, Mycobacterium tuberculosis
  CDS (1)..(234)
tggcggccgcgcgccatggtgtgcaccagttgcgatcggttctcccgcgcgcgggcggcgacgacgtcgatggccgcgccccggcggctgcagctgcgtagctcgacccggtcgacgacgacggggtcggcgggccagtcggcgatgtcgaggcgatggcaatacagcgccttggtgcgcggccacacgtctgaggtggcgaagaccagtcccgcgcccaccggcagccggatc

SEQ ID NO: 332 - protein, 78 aa, Mycobacterium tuberculosis
WRPRAMVCTSCDRFSRARAATTSMAAPRRLQLRSSTRSTTTGSAGQSAMSRRWQYSALVRGHTSEVAKTSPAPTGSRI

SEQ ID NO: 333 - DNA, 615 bp, Mycobacterium tuberculosis
  CDS (4)..(612)
taaggtccgccaacgctttacgctcgacggccgccacgagttggccggccactttcaggccgtagtcgccgcagggcagggcttcccgcgtcgtcttcgcgggtttgtcggcaaaggtgtaggggtagcgttcgtgggcgtcgacgacgatgtgcagctcggggatgccggcggcgcgggcggtgggggtgcgcacgcccggccgcgactgtttgcgcgttttggggctctgccagaacaccacctggcggccgcgcgccatggtgtgcaccagttgcgatcggttctcccgcgcgcgggcggcgacgacgtcgatggccgcgccccggcggctgcagctgcgtagctcgacccggtcgacgacgacggggtcggcgggccagtcggcgatgtcgaggcgatggcaatacagcgccttggtgcgcggccacacgtctgaggtggcgaagaccagtcccgcgcccaccggcagccggatcaggtagggcaggcgcgagtcttcagcggggttggcggcgacgagcagctccacagagtgtgagggtacgggcggcgtacggcaacggtgaagcaggcactccgacgaacccatcgtcacgtcgaaggggcaggtga

SEQ ID NO: 334 - protein, 203 aa, Mycobacterium tuberculosis
GPPTLYARRPPRVGRPLSGRSRRRAGLPASSSRVCRQRCRGSVRGRRRRCAARGCRRRGRWGCARPAATVCAFWGSARTPPGGRAPWCAPVAIGSPARGRRRRRWPRPGGCSCVARPGRRRRGRRASRRCRGDGNTAPWCAATRLRWRRPVPRPPAAGSGRAGASLQRGWRRRAAPQSVRVRAAYGNGEAGTPTNPSSRRRGR

SEQ ID NO: 335 - DNA, 420 bp, Mycobacterium tuberculosis
  CDS (1)..(417)
gtgacggcactgctcgatgtcaatgtgctgatcgcgctgggctggccgaatcacgttcaccatgcggccgcgcagcgatggttcacgcagttctcctcgaatgggtgggccaccacgccgatcaccgaggcagggtatgtccgaatttcaagcaatcgcagtgtgatgcaggtgtcgaccacgccggctatcgcgatcgctcagttggcggcgatgacttctcttgccgggcacacgttttggcctgacgatgtgccactgatcgttgggagcgccggcgatcgcgatgcggtgtccaaccaccgtcgggtcaccgactgccatctcatcgccttggccgcgcgctacgggggccggttggtcacattcgatgccgcactggccgattcagcatccgcaggcctcgtcgaggtgttgtag

SEQ ID NO: 336 - protein, 139 aa, Mycobacterium tuberculosis
VTALLDVNVLIALGWPNHVHHAAAQRWFTQFSSNGWATTPITEAGYVRISSNRSVMQVSTTPAIAIAQLAAMTSLAGHTFWPDDVPLIVGSAGDRDAVSNHRRVTDCHLIALAARYGGRLVTFDAALADSASAGLVEVL

SEQ ID NO: 337 - DNA, 486 bp, Mycobacterium tuberculosis
  CDS (4)..(483)
tgatgttccgccggatgcgccgacggtgacttccgaggatgtcgtccgcgcgctcgaggacgacgtgtgacggcactgctcgatgtcaatgtgctgatcgcgctgggctggccgaatcacgttcaccatgcggccgcgcagcgatggttcacgcagttctcctcgaatgggtgggccaccacgccgatcaccgaggcagggtatgtccgaatttcaagcaatcgcagtgtgatgcaggtgtcgaccacgccggctatcgcgatcgctcagttggcggcgatgacttctcttgccgggcacacgttttggcctgacgatgtgccactgatcgttgggagcgccggcgatcgcgatgcggtgtccaaccaccgtcgggtcaccgactgccatctcatcgccttggccgcgcgctacgggggccggttggtcacattcgatgccgcactggccgattcagcatccgcaggcctcgtcgaggtgttgtag

SEQ ID NO: 338 - protein, 160 aa, Mycobacterium tuberculosis
CSAGCADGDFRGCRPRARGRRVTALLDVNVLIALGWPNHVHHAAAQRWFTQFSSNGWATTPITEAGYVRISSNRSVMQVSTTPAIAIAQLAAMTSLAGHTFWPDDVPLIVGSAGDRDAVSNHRRVTDCHLIALAARYGGRLVTFDAALADSASAGLVEVL

SEQ ID NO: 339 - DNA, 1520 bp, Mycobacterium tuberculosis
  CDS (4)..(483)
  CDS (487)..(675)
  CDS (679)..(1248)
  CDS (1252)..(1341)
  CDS (1345)..(1443)
  CDS (1447)..(1518)
tgatgttccgccggatgcgccgacggtgacttccgaggatgtcgtccgcgcgctcgaggacgacgtgtgacggcactgctcgatgtcaatgtgctgatcgcgctgggctggccgaatcacgttcaccatgcggccgcgcagcgatggttcacgcagttctcctcgaatgggtgggccaccacgccgatcaccgaggcagggtatgtccgaatttcaagcaatcgcagtgtgatgcaggtgtcgaccacgccggctatcgcgatcgctcagttggcggcgatgacttctcttgccgggcacacgttttggcctgacgatgtgccactgatcgttgggagcgccggcgatcgcgatgcggtgtccaaccaccgtcgggtcaccgactgccatctcatcgccttggccgcgcgctacgggggccggttggtcacattcgatgccgcactggccgattcagcatccgcaggcctcgtcgaggtgttgtagtcaccggggatgggcggctcgccaggcctgcaggatctgcgggcgcaggcgcccccggtcggacaccggcaggccgacgcttttggcccacgcgcgcagctcggcgctgctgggctcgggctcggcggcagccggctcgaaaaccgtggtggcgtcggcatcgtcgacgaaccaggtgagggcggcggctagatagcggtaggtgtattcctgggcgagcttgcgggtttggcagaacacgatcggcacgttgggaaagccgatctgcaattcggccagcccatcggcgatcgccgtcgggcgggcgaaggagtgcgcgaagatctccgagtagcggtcctcgaccaccacggcggcccgtggcagcgcggccagttcggtcagttggtatttcaggttgccgttcagcacgccagaagtaaggtccgccaacgctttacgctcgacggccgccacgagttggccggccactttcaggccgtagtcgccgcagggcagggcttcccgcgtcgtcttcgcgggtttgtcggcaaaggtgtaggggtagcgttcgtgggcgtcgacgacgatgtgcagctcggggatgccggcggcgcgggcggtgggggtgcgcacgcccggccgcgactgtttgcgcgttttggggctctgccagaacaccacctggcggccgcgcgccatggtgtgcaccagttgcgatcggttctcccgcgcgcgggcggcgacgacgtcgatggccgcgccccggcggctgcagctgcgtagctcgacccggtcgacgacgacggggtcggcgggccagtcggcgatgtcgaggcgatggcaatacagcgccttggtgcgcggccacacgtctgaggtggcgaagaccagtcccgcgcccaccggcagccggatcaggtagggcaggcgcgagtcttcagcggggttggcggcgacgagcagctccacagagtgtgagggtacgggcggcgtacggcaacggtgaagcaggcactccgacgaacccatcgtcacgtcgaaggggcaggtga

SEQ ID NO: 340 - protein, 160 aa, Mycobacterium tuberculosis; identical to SEQ ID NO: 338

SEQ ID NO: 341 - protein, 63 aa, Mycobacterium tuberculosis
SPGMGGSPGLQDLRAQAPPVGHRQADAFGPRAQLGAAGLGLGGSRLENRGGVGIVDEPGEGGG

SEQ ID NO: 342 - protein, 190 aa, Mycobacterium tuberculosis
IAVGVFLGELAGLAEHDRHVGKADLQFGQPIGDRRRAGEGVREDLRVAVLDHHGGPWQRGQFGQLVFQVAVQHARSKVRQRFTLDGRHELAGHFQAVVAAGQGFPRRLRGFVGKGVGVAFVGVDDDVQLGDAGGAGGGGAHARPRLFARFGALPEHHLAAARHGVHQLRSVLPRAGGDDVDGRAPAAAAA

SEQ ID NO: 343 - protein, 30 aa, Mycobacterium tuberculosis; identical to SEQ ID NO: 319

SEQ ID NO: 344 - protein, 33 aa, Mycobacterium tuberculosis
GGEDQSRAHRQPDQVGQARVFSGVGGDEQLHRV

SEQ ID NO: 345 - protein, 24 aa, Mycobacterium tuberculosis
GYGRRTATVKQALRRTHRHVEGAG

SEQ ID NO: 346 - DNA, 1520 bp, Mycobacterium tuberculosis; identical to SEQ ID NO: 339

SEQ ID NO: 347 - DNA, 1520 bp, Mycobacterium tuberculosis; identical to SEQ ID NO: 339
  CDS (3)..(26)
  CDS (30)..(311)
  CDS (315)..(662)
  CDS (666)..(905)
  CDS (909)..(1517)

SEQ ID NO: 348 - protein, 8 aa, Mycobacterium tuberculosis
MFRRMRRR

SEQ ID NO: 349 - protein, 94 aa, Mycobacterium tuberculosis
LPRMSSARSRTTCDGTARCQCADRAGLAESRSPCGRAAMVHAVLLEWVGHHADHRGRVCPNFKQSQCDAGVDHAGYRDRSVGGDDFSCRAHVLA

SEQ ID NO: 350 - protein, 116 aa, Mycobacterium tuberculosis
RCATDRWERRRSRCGVQPPSGHRLPSHRLGRALRGPVGHIRCRTGRFSIRRPRRGVVVTGDGRLARPAGSAGAGAPGRTPAGRRFWPTRAARRCWARARRQPARKPWWRRHRRRTR

SEQ ID NO: 351 - protein, 80 aa, Mycobacterium tuberculosis
GRRLDSGRCIPGRACGFGRTRSARWESRSAIRPAHRRSPSGGRRSARRSPSSGPRPPRRPVAARPVRSVGISGCRSARQK

SEQ ID NO: 352 - protein, 203 aa, Mycobacterium tuberculosis; identical to SEQ ID NO: 334

SEQ ID NO: 353 - DNA, 400 bp, Mycobacterium tuberculosis
  CDS (1)..(174)
  CDS (178)..(315)
  CDS (319)..(399)
tgcgcatgccgaccagtgtggttggccggagttcgtttgttcgcgattgcctcaacgattcgatataaccactctagtcacatcaaccacactcgtaccatcgagcgtgtgggttcatgccatgcattcgcgaccgcgggagccggcgaacccggcgccacacataatccagattgaggagacttccgtgccgaaccgacgccgacgcaagctttcgacagccatgagcgcggtcgccgccctggcagttgcaagtccttgtgcatattttcttgtctacgaatcaaccgaaacgaccgagcggcccgagcaccatgaattcaagcaggcggcggtgttgaccgacctgcccggcgagctgatgtccgcgctatcgcaggggttgtcccagttcgggatc

SEQ ID NO: 354 - protein, 58 aa, Mycobacterium tuberculosis
CACRPVWLAGVRLFAIASTIRYNHSSHINHTRTIERVGSCHAFATAGAGEPGATHNPD

SEQ ID NO: 355 - protein, 46 aa, Mycobacterium tuberculosis
GDFRAEPTPTQAFDSHERGRRPGSCKSLCIFSCLRINRNDRAARAP

SEQ ID NO: 356 - protein, 27 aa, Mycobacterium tuberculosis
IQAGGGVDRPARRADVRAIAGVVPVRD

SEQ ID NO: 357 - DNA, 399 bp, Mycobacterium tuberculosis
  CDS (1)..(399)
gcgcatgccgaccagtgtggttggccggagttcgtttgttcgcgattgcctcaacgattcgatataaccactctagtcacatcaaccacactcgtaccatcgagcgtgtgggttcatgccatgcattcgcgaccgcgggagccggcgaacccggcgccacacataatccagattgaggagacttccgtgccgaaccgacgccgacgcaagctttcgacagccatgagcgcggtcgccgccctggcagttggaagtccttgtgcatattttcttgtctacgaatcaaccgaaacgaccgagcggcccgagcaccatgaattcaagcaggcggcggtgttgaccgacctgcccggcgagctgatgtccgcgctatcgcaggggttgtcccagttcgggatc

SEQ ID NO: 358 - protein, 133 aa, Mycobacterium tuberculosis
AHADQCGWPEFVCSRLPQRFDITTLVTSTTLVPSSVWVHAMHSRPREPANPAPHIIQIEETSVPNRRRRKLSTAMSAVAALAVGSPCAYFLVYESTETTERPEHHEFKQAAVLTDLPGELMSALSQGLSQFGI

SEQ ID NO: 359 - DNA, 398 bp, Mycobacterium tuberculosis
  CDS (1)..(63)
  CDS (67)..(72)
  CDS (76)..(162)
  CDS (166)..(222)
  CDS (226)..(336)
  CDS (340)..(357)
  CDS (361)..(396)
cgcatgccgaccagtgtggttggccggagttcgtttgttcgcgattgcctcaacgattcgatataaccactctagtcacatcaaccacactcgtaccatcgagcgtgtgggttcatgccatgcattcgcgaccgcgggagccggcgaacccggcgccacacataatccagattgaggagacttccgtgccgaaccgacgccgacgcaagctttcgacagccatgagcgcggtcgccgccctggcagttgcaagtccttgtgcatattttcttgtctacgaatcaaccgaaacgaccgagcggcccgagcaccatgaattcaagcaggcggcggtgttgaccgacctgcccggcgagctgatgtccgcgctatcgcaggggttgtcccagttcgggatc

SEQ ID NO: 360 - protein, 21 aa, Mycobacterium tuberculosis
RMPTSVVGRSSFVRDCLNDSI

SEQ ID NO: 361 - DNA, 359 bp, Mycobacterium tuberculosis
  CDS (1)..(51)
  CDS (55)..(354)
gcgggccaccgatcagtcgatcgggtggtttccgctccatcagcccggaattgaggtgccgcagtgacgacaccagcgcaggacgcgccgttggtgtttccctctgttgctttcccgtccggctcgcctttttttcatcaacgttggactgccgcagtggcgatgttggtcgccggcgtgttcggtcacctgacggtcgggatgttccttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatgcctcgggctgatc

SEQ ID NO: 362 - protein, 17 aa, Mycobacterium tuberculosis
AGHRSVDRVVSAPSARN

SEQ ID NO: 363 - protein, 100 aa, Mycobacterium tuberculosis
GAAVTTPAQDAPLVFPSVAFPSGSPFFHQRWTAAVAMLVAGVFGHLTVGMFLGSRVAAGFAQCPAGAAFGRVDHRQRAPVKTVDGPQLGIATGDYHHASG

SEQ ID NO: 364 - DNA, 358 bp, Mycobacterium tuberculosis
  CDS (1)..(63)
  CDS (67)..(189)
  CDS (193)..(357)
cgggccaccgatcagtcgatcgggtggtttccgctccatcagcccggaattgaggtgccgcagtgacgacaccagcgcaggacgcgccgttggtgtttccctctgttgctttcccgtccggctcgcctttttttcatcaacgttggactgccgcagtggcgatgttggtcgccggcgtgttcggtcacctgacggtcgggatgttccttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatgcctcgggctgatc

SEQ ID NO: 365 - protein, 21 aa, Mycobacterium tuberculosis
RATDQSIGWFPLHQPGIEVPQ

SEQ ID NO: 366 - protein, 41 aa, Mycobacterium tuberculosis
RHQRRTRRWCFPLLLSRPARLFFINVGLPQWRCWSPACSVT

SEQ ID NO: 367 - protein, 55 aa, Mycobacterium tuberculosis
RSGCSLGLGLLLGLLNALLVRRSAESITAKEHPLKRSMALNSASRLAIITMPRAD

SEQ ID NO: 368 - DNA, 357 bp, Mycobacterium tuberculosis
  CDS (1)..(291)
  CDS (295)..(357)
gggccaccgatcagtcgatcgggtggtttccgctccatcagcccggaattgaggtgccgcagtgacgacaccagcgcaggacgcgccgttggtgtttccctctgttgctttcccgtccggctcgcctttttttcatcaacgttggactgccgcagtggcgatgttggtcgccggcgtgttcggtcacctgacggtcgggatgttccttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatgcctcgggctgatc

SEQ ID NO: 369 - protein, 97 aa, Mycobacterium tuberculosis
GPPISRSGGFRSISPELRCRSDDTSAGRAVGVSLCCFPVRLAFFSSTLDCRSGDVGRRRVRSPDGRDVPWVSGCCWVCSMPCWCGVRPSRSPPKSTR

SEQ ID NO: 370 - protein, 21 aa, Mycobacterium tuberculosis
NGRWPSTRHRDWRLSPCLGLI

SEQ ID NO: 371 - DNA, 492 bp, Mycobacterium tuberculosis
  CDS (1)..(3)
  CDS (7)..(186)
  CDS (190)..(492)
ggctagaaccccgaaggagacctcgcgggttgccggcccccggcccatcggatgcgtatccggtcgcgccgattcacgaccgacatagggagctaccccttgggtgattccggtgcgacgactgcgatacgctcggcgggccaccgatcagtcgatcgggtggtttccgctccatcagcccggaattgaggtgccgcagtgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatc

SEQ ID NO: 372 - protein, 60 aa, Mycobacterium tuberculosis
NPEGDLAGCRPPAHRMRIRSRRFTTDIGSYPLGDSGATTAIRSAGHRSVDRVVSAPSARN

SEQ ID NO: 373 - protein, 101 aa, Mycobacterium tuberculosis
GAAVTTPAQDAPLVFPSVAFRPVRLFFINVGLAAVAMLVAGVFGHLTVGMFLGLGLLLGLLNALLVRRSAESITAKEHPLKRSMALNSASRLAIITILGLI

SEQ ID NO: 374 - DNA, 491 bp, Mycobacterium tuberculosis
  CDS (1)..(84)
  CDS (88)..(198)
  CDS (202)..(324)
  CDS (328)..(426)
  CDS (430)..(486)
gctagaaccccgaaggagacctcgcgggttgccggcccccggcccatcggatgcgtatccggtcgcgccgattcacgaccgacatagggagctaccccttgggtgattccggtgcgacgactgcgatacgctcggcgggccaccgatcagtcgatcgggtggtttccgctccatcagcccggaattgaggtgccgcagtgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatc

SEQ ID NO: 375 - protein, 28 aa, Mycobacterium tuberculosis
ARTPKETSRVAGPRPIGCVSGRADSRPT

SEQ ID NO: 376 - protein, 37 aa, Mycobacterium tuberculosis
GATPWVIPVRRLRYARRATDQSIGWFPLHQPGIEVPQ

SEQ ID NO: 377 - protein, 41 aa, Mycobacterium tuberculosis
RHQRRTRRWCFPLLLSVRFAFFSSTLDWPQWRCWSPACSVT

SEQ ID NO: 378 - protein, 33 aa, Mycobacterium tuberculosis
RSGCSWVSGCCWVCSMPCWCGVRPSRSPPKSTR

SEQ ID NO: 379 - protein, 19 aa, Mycobacterium tuberculosis
NGRWPSTRHRDWRLSPSSG

SEQ ID NO: 380 - DNA, 490 bp, Mycobacterium tuberculosis
  CDS (1)..(102)
  CDS (106)..(489)
ctagaaccccgaaggagacctcgcgggttgccggcccccggcccatcggatgcgtatccggtcgcgccgattcacgaccgacatagggagctaccccttgggtgattccggtgcgacgactgcgatacgctcggcgggccaccgatcagtcgatcgggtggtttccgctccatcagcccggaattgaggtgccgcagtgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatc

SEQ ID NO: 381 - protein, 34 aa, Mycobacterium tuberculosis
LEPRRRPRGLPAPGPSDAYPVAPIHDRHRELPLG

SEQ ID NO: 382 - protein, 128 aa, Mycobacterium tuberculosis
FRCDDCDTLGGPPISRSGGFRSISPELRCRSDDTSAGRAVGVSLCCFPSGSPFFHQRWTGRSGDVGRRRVRSPDGRDVLGSRVAAGFAQCPAGAAFGRVDHRQRAPVKTVDGPQLGIATGDYHHPRAD

SEQ ID NO: 383 - DNA, 486 bp, Mycobacterium tuberculosis
  CDS (1)..(483)
atgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatcatcgcctacattttccggcccgctggattgggcgtcgtgttcgggctggcattcttccaggtgctgctggtggcaacgacggccctgccggtcctgaagaagctgcgcactgcgaccgaggaaccggtcgcaacttattcttccaatggccagaccgggggatcggaaggaaggagcgccagcgatgactga

SEQ ID NO: 384 - protein, 161 aa, Mycobacterium tuberculosis
MTTPAQDAPLVFPSVAFRPVRLFFINVGLAAVAMLVAGVFGHLTVGMFLGLGLLLGLLNALLVRRSAESITAKEHPLKRSMALNSASRLAIITILGLIIAYIFRPAGLGVVFGLAFFQVLLVATTALPVLKKLRTATEEPVATYSSNGQTGGSEGRSASDD

SEQ ID NO: 385 - DNA, 498 bp, Mycobacterium tuberculosis
  CDS (4)..(495)
tgaggtgccgcagtgacgacaccagcgcaggacgcgccgttggtgtttccctctgttgctttccgtccggttcgcctttttttcatcaacgttggactggccgcagtggcgatgttggtcgccggcgtgttcggtcacctgacggtcgggatgttcttgggtctcgggttgctgctgggtttgctcaatgccctgctggtgcggcgttcggccgagtcgatcaccgccaaagagcacccgttaaaacggtcgatggccctcaactcggcatcgcgactggcgattatcaccatcctcgggctgatcatcgcctacattttccggcccgctggattgggcgtcgtgttcgggctggcattcttccaggtgctgctggtggcaacgacggccctgccggtcctgaagaagctgcgcactgcgaccgaggaaccggtcgcaacttattcttccaatggccagaccgggggatcggaaggaaggagcgccagcgatgactga

SEQ ID NO: 386 - protein, 164 aa, Mycobacterium tuberculosis
GAAVTTPAQDAPLVFPSVAFRPVRLFFINVGLAAVAMLVAGVFGHLTVGMFLGLGLLLGLLNALLVRRSAESITAKEHPLKRSMALNSASRLAIITILGLIIAYIFRPAGLGVVFGLAFFQVLLVATTALPVLKKLRTATEEPVATYSSNGQTGGSEGRSASDD

SEQ ID NO: 387 - DNA, 390 bp, Mycobacterium tuberculosis
  CDS (1)..(390)
gtcgaacaggtacggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtcccgatgttctcgacctacggtatcgcctcgacactactcggcgtgctatcggtcgccgcggtcgtgctgggtgcgatgatc

SEQ ID NO: 388 - protein, 130 aa, Mycobacterium tuberculosis
VEQVRKAPSVARSAGISCSASQRPLTWPNRSSWGRASASMWLRSIPEGMASVTPPSFHLFSGATIGPCLTGSRASHRPKKMRKTTRGPTPRRPPRPNPNHQPVPMFSTYGIASTLLGVLSVAAVVLGAMI

SEQ ID NO: 389 - DNA, 389 bp, Mycobacterium tuberculosis
  CDS (1)..(72)
  CDS (76)..(204)
  CDS (208)..(384)
tcgaacaggtacggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtcccgatgttctcgacctacggtatcgcctcgacactactcggcgtgctatcggtcgccgcggtcgtgctgggtgcgatgatc

SEQ ID NO: 390 - protein, 24 aa, Mycobacterium tuberculosis
SNRYGRRRRSLGPLVSRVQPASGR

SEQ ID NO: 391 - protein, 43 aa, Mycobacterium tuberculosis
RGRTGRLGVGHQRRCGSGRYPRGWQVSPRHPSTSFRVQRSGHA

SEQ ID NO: 392 - protein, 59 aa, Mycobacterium tuberculosis
RGAEPATGPRRCGRRLAARRRGGRRGRTQIISRSRCSRPTVSPRHYSACYRSPRSCWVR

SEQ ID NO: 393 - DNA, 388 bp, Mycobacterium tuberculosis
  CDS (1)..(387)
cgaacaggtacggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtcccgatgttctcgacctacggtatcgcctcgacactactcggcgtgctatcggtcgccgcggtcgtgctgggtgcgatgatc

SEQ ID NO: 394 - protein, 129 aa, Mycobacterium tuberculosis
RTGTEGAVGRSVRWYLVFSQPAAVNVAEQVVLGSGISVDVAQVDTRGDGKCHPAILPPLFGCNDRAMPDGEQSQPPAQEDAEDDSRPDAAEAAAAEPKSSAGPDVLDLRYRLDTTRRAIGRRGRAGCDD

SEQ ID NO: 395 - DNA, 375 bp, Mycobacterium tuberculosis
  CDS (1)..(375)
gaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtccgatgttctcgacctacggtatcgcctcgacactactcggcgtgctatcggtcgccgcggtcgtgctgggtgcgatgatc

SEQ ID NO: 396 - protein, 125 aa, Mycobacterium tuberculosis
EGAVGRSVRWYLVFSQPAAVNVAEQVVLGSGISVDVAQVDTRGDGKCHPAILPPLFGCNDRAMPDGEQSQPPAQEDAEDDSRPDAAEAAAAEPKSSAGPMFSTYGIASTLLGVLSVAAVVLGAMI

SEQ ID NO: 397 - DNA, 377 bp, Mycobacterium tuberculosis
  CDS (1)..(372)
cggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtccgatgttctcgacctacggtatcgcctcgacactactcggcgtgctatcggtcgccgcggtcgtgctgggtgcgatgatc

SEQ ID NO: 398 - protein, 124 aa, Mycobacterium tuberculosis
RKAPSVARSAGISCSASQRPLTWPNRSSWGRASASMWLRSIPEGMASVTPPSFHLFSGATIGPCLTGSRASHRPKKMRKTTRGPTPRRPPRPNPNHQPVRCSRPTVSPRHYSACYRSPRSCWVR

SEQ ID NO: 399 - DNA, 376 bp, Mycobacterium tuberculosis
  CDS (1)..(60)
  CDS (64)..(192)
  CDS (196)..(375)
ggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtccgatgttctcgacctacggtatcgcctcgacactactcggcgtgctatcggtcgccgcggtcgtgctgggtgcgatgatc

SEQ ID NO: 400 - protein, 20 aa, Mycobacterium tuberculosis
GRRRRSLGPLVSRVQPASGR

SEQ ID NO: 401 - protein, 43 aa, Mycobacterium tuberculosis; identical to SEQ ID NO: 391

SEQ ID NO: 402 - protein, 60 aa, Mycobacterium tuberculosis
RGAEPATGPRRCGRRLAARRRGGRRGRTQIISRSDVLDLRYRLDTTRRAIGRRGRAGCDD

SEQ ID NO: 403 - DNA, 660 bp, Mycobacterium tuberculosis
  CDS (1)..(657)
atgcctgacggggagcagagccagccaccggcccaagaagatgcggaagacgactcgcggcccgacgccgcggaggccgccgcggccgaacccaaatcatcagccggtccgatgttctcgacctacggtatcgcctcgacactactcggcgtgctatcggtcgccgcggtcgtgctgggtgcgatgatctggtccgcacaccgcgatgactccggcgagcgtacctacctgacccgggtcatgctgaccgccgctgaatggacggccgtgctgatcaacatgaacgccgacaacatcgatgccagcctgcagcgactgcacgacggaacggtcggtcaactcaacaccgacttcgacgctgtcgtgcagccctaccggcaggtggtggagaagttgcggacgcacagcagcggcaggatcgaggcggtagcgatcgatacggtgcaccgcgagctggatacccagtccggtgccgcccgaccggtagtaaccacgaaattgccaccgtttgccactcgcaccgactcggtgctgctggtcgcgacgtcggtcagtgagaacgccggcgccaaaccccagaccgtgcactggaacttgcggctcgatgtctccgatgtggacggcaagctgatgatctcccggttggagtcgattcgatga

SEQ ID NO: 404 - protein, 219 aa, Mycobacterium tuberculosis
MPDGEQSQPPAQEDAEDDSRPDAAEAAAAEPKSSAGPMFSTYGIASTLLGVLSVAAVVLGAMIWSAHRDDSGERTYLTRVMLTAAEWTAVLINMNADNIDASLQRLHDGTVGQLNTDFDAVVQPYRQVVEKLRTHSSGRIEAVAIDTVHRELDTQSGAARPVVTTKLPPFATRTDSVLLVATSVSENAGAKPQTVHWNLRLDVSDVDGKLMISRLESIR

SEQ ID NO: 405 - DNA, 1176 bp, Mycobacterium tuberculosis
  CDS (4)..(1173)
taatccgatgccggattgggtgaaatgcaccaagtaacgggtcgagtctttggaatcggtatcgacatagactccgatgccgccgcccacgccggcacgttgcagagtgccaagggcggcggccaattcggtggcgtcggccgcgctgtcaatcgtggccaattcgtcgtgcagcggttgcacccctgcgcgctcgacggcttcctcgtcgaggaagctggcgtagaggtcgccgatgcgctgcgcatcggtgcctaccgcagcacctgcttggctggcctggatgatcaggtctcgcacttgtgtctcggcgcggtcgaacaggctacggaaggcgccgtcggtcgctcggtccgctggtatctcgtgttcagccagccagcggccgttaacgtggccgaacaggtcgtcttggggtcgggcatcagcgtcgatgtggctcaggtcgatacccgaggggatggcaagtgtcaccccgccatccttccacctcttttcgggtgcaacgatcgggccatgcctgacggggagcagagccagccaccggcccaagaagatgcggaagacgactcgcggcccgacgccgcggaggccgccgcggccgaacccaaatcatcagccggtccgatgttctcgacctacggtatcgcctcgacactactcggcgtgctatcggtcgccgcggtcgtgctgggtgcgatgatctggtccgcacaccgcgatgactccggcgagcgtacctacctgacccgggtcatgctgaccgccgctgaatggacggccgtgctgatcaacatgaacgccgacaacatcgatgccagcctgcagcgactgcacgacggaacggtcggtcaactcaacaccgacttcgacgctgtcgtgcagccctaccggcaggtggtggagaagttgcggacgcacagcagcggcaggatcgaggcggtagcgatcgatacggtgcaccgcgagctggatacccagtccggtgccgcccgaccggtagtaaccacgaaattgccaccgtttgccactcgcaccgactcggtgctgctggtcgcgacgtcggtcagtgagaacgccggcgccaaaccccagaccgtgcactggaacttgcggctcgatgtctccgatgtggacggcaagctgatgatctcccggttggagtcgattcgatga

SEQ ID NO: 406 - protein, 390 aa, Mycobacterium tuberculosis
SDAGLGEMHQVTGRVFGIGIDIDSDAAAHAGTLQSAKGGGQFGGVGRAVNRGQFVVQRLHPCALDGFLVEEAGVEVADALRIGAYRSTCLAGLDDQVSHLCLGAVEQATEGAVGRSVRWYLVFSQPAAVNVAEQVVLGSGISVDVAQVDTRGDGKCHPAILPPLFGCNDRAMPDGEQSQPPAQEDAEDDSRPDAAEAAAAEPKSSAGPMFSTYGIASTLLGVLSVAAVVLGAMIWSAHRDDSGERTYLTRVMLTAAEWTAVLINMNADNIDASLQRLHDGTVGQLNTDFDAVVQPYRQVVEKLRTHSSGRIEAVAIDTVHRELDTQSGAARPVVTTKLPPFATRTDSVLLVATSVSENAGAKPQTVHWNLRLDVSDVDGKLMISRLESIR

SEQ ID NO: 407 - DNA, 380 bp, Mycobacterium tuberculosis
  CDS (1)..(153)
  CDS (157)..(378)
gttgcgcaacggggtgagcaccgacgcgatgatggcgcaactatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 408 - protein, 51 aa, Mycobacterium tuberculosis
VAQRGEHRRDDGATIETAGHRQRQRRHSRGGHPWLSGQRRLCGKHTAQQRF

SEQ ID NO: 409 - protein, 74 aa, Mycobacterium tuberculosis
CANPGVLRSRVQGRKRGGDPRRQHRGGEGARVQPRHTAGRGDGPAGGCPRRRQSGLQSVGLRQAAGVRCGGAGR

SEQ ID NO: 410 - DNA, 379 bp, Mycobacterium tuberculosis
  CDS (1)..(378)
ttgcgcaacggggtgagcaccgacgcgatgatggcgcaactatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 411 - protein, 126 aa, Mycobacterium tuberculosis
LRNGVSTDAMMAQLSKLQDIANANDGTRAVGTPGYQASVDYVVNTLRNSGFDVQTPEFSARVFKAEKGVVTLGGNTVEARALEYSLGTPPDGVTGPLVAAPADDSPGCSPSDYDRLPVSGAVVLVD

SEQ ID NO: 412 - DNA, 378 bp, Mycobacterium tuberculosis
  CDS (1)..(12)
  CDS (16)..(27)
  CDS (31)..(126)
  CDS (130)..(207)
  CDS (211)..(276)
  CDS (280)..(372)
  CDS (376)..(378)
tgcgcaacggggtgagcaccgacgcgatgatggcgcaactatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 413 - protein, 4 aa, Mycobacterium tuberculosis
CATG

SEQ ID NO: 414 - protein, 4 aa, Mycobacterium tuberculosis
APTR

SEQ ID NO: 415 - protein, 32 aa, Mycobacterium tuberculosis
WRNYRNCRTSPTPTTALARWAPLAIRPASTMW

SEQ ID NO: 416 - protein, 26 aa, Mycobacterium tuberculosis
THCATAVLMCKPRSSPLACSRPKKGW

SEQ ID NO: 417 - protein, 22 aa, Mycobacterium tuberculosis
PSAATPWRRGRSSTASAHRRTG

SEQ ID NO: 418 - protein, 31 aa, Mycobacterium tuberculosis
RARWWLPPPTTVRAAVRRTTTGCRCPVRWCW

SEQ ID NO: 419 - DNA, 340 bp, Mycobacterium tuberculosis
  CDS (1)..(339)
ctatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 420 - protein, 113 aa, Mycobacterium tuberculosis
LSKLQDIANANDGTRAVGTPGYQASVDYVVNTLRNSGFDVQTPEFSARVFKAEKGVVTLGGNTVEARALEYSLGTPPDGVTGPLVAAPADDSPGCSPSDYDRLPVSGAVVLVD

SEQ ID NO: 421 - DNA, 339 bp, Mycobacterium tuberculosis
  CDS (1)..(87)
  CDS (91)..(168)
  CDS (172)..(237)
  CDS (241)..(333)
  CDS (337)..(339)
tatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 422 - protein, 29 aa, Mycobacterium tuberculosis
YRNCRTSPTPTTALARWAPLAIRPASTMW

SEQ ID NO: 423 - protein, 26 aa, Mycobacterium tuberculosis
THCATAVLMCKPRSSPLACSRPKKGW

SEQ ID NO: 424 - protein, 22 aa, Mycobacterium tuberculosis
PSAATPWRRGRSSTASAHRRTG

SEQ ID NO: 425 - protein, 31 aa, Mycobacterium tuberculosis; identical to SEQ ID NO: 418

SEQ ID NO: 426 - DNA, 338 bp, Mycobacterium tuberculosis
  CDS (1)..(111)
  CDS (115)..(336)
atcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatc

SEQ ID NO: 427 - protein, 37 aa, Mycobacterium tuberculosis
IETAGHRQRQRRHSRGGHPWLSGQRRLCGKHTAQQRF

SEQ ID NO: 428 - protein, 74 aa, Mycobacterium tuberculosis; identical to SEQ ID NO: 409

SEQ ID NO: 429 - DNA, 1503 bp, Mycobacterium tuberculosis
  CDS (1)..(1500)
atggtgaacaaatccaggatgatgccggcggtgctggccgtggctgtggtcgtcgcattcctgacgacgggctgtatccggtggtctacgcagtcgcggcccgttgttaacggccccgctgccgcagagttcgccgttgcgttgcgcaaccgggtgagcaccgacgcgatgatggcgcacctatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatcgcggcgtctgtccttttgcccagaaggaagacgcagccgcgcagcgcggtgcggtggcgctgatcattgctgacaacatcgacgagcaggcgatgggcggcaccctgggggctaataccgacgtcaagatcccggtggtgagtgtcaccaagtcggtcggattccagctacgcggacagtctgggccaaccaccgtcaagctcacggcgagcacccaaagtttcaaggcccgcaacgtcatcgcgcagacgaagacggggtcgtcggccaacgtggtgatggcaggtgcgcatttggacagcgttccggaaggacccggcatcaacgacaacggctcgggagtggctgcggttctggaaacggcagtgcagctggggaactcaccgcatgtgtccaacgcggtacggttcgccttctggggcgccgaggaattcggcctgattgggtcacgaaactacgtcgagtcgctggacatcgacgcgctcaaaggcatcgcgctgtatctgaacttcgacatgttggcgtcgccgaacccgggttacttcacctacgacggtgaccagtcgctgccgctagacgcccgcggtcagccggtggtgcccgaaggctcggccggtatcgagcgcacgttcgtcgcctatctgaagatggccggcaagaccgcgcaggacacctcgttcgacggtcggtccgactacgacggcttcacgctggcgggtatcccttcgggtggcctgttctccggcgctgaggtcaagaagtccgccgagcaagccgagctctggggcggcaccgccgacgagcctttcgatcccaactatcaccagaagacagacaccctggaccatatcgaccgcaccgcgctcggtatcaacggcgctggcgtcgcgtacgcggtgggtttgtatgcgcaggacctcggcggccccaacggggttccggtcatggcggaccgcacccgccacctgattgccaaaccgtga

SEQ ID NO: 430 - protein, 500 aa, Mycobacterium tuberculosis
MVNKSRMMPAVLAVAVVVAFLTTGCIRWSTQSRPVVNGPAAAEFAVALRNRVSTDAMMAHLSKLQDIANANDGTRAVGTPGYQASVDYVVNTLRNSGFDVQTPEFSARVFKAEKGVVTLGGNTVEARALEYSLGTPPDGVTGPLVAAPADDSPGCSPSDYDRLPVSGAVVLVDRGVCPFAQKEDAAAQRGAVALIIADNIDEQAMGGTLGANTDVKIPVVSVTKSVGFQLRGQSGPTTVKLTASTQSFKARNVIAQTKTGSSANVVMAGAHLDSVPEGPGINDNGSGVAAVLETAVQLGNSPHVSNAVRFAFWGAEEFGLIGSRNYVESLDIDALKGIALYLNFDMLASPNPGYFTYDGDQSLPLDARGQPVVPEGSAGIERTFVAYLKMAGKTAQDTSFDGRSDYDGFTLAGIPSGGLFSGAEVKKSAEQAELWGGTADEPFDPNYHQKTDTLDHIDRTALGINGAGVAYAVGLYAQDLGGPNGVPVMADRTRHLIAKP

SEQ ID NO: 431 - DNA, 1587 bp, Mycobacterium tuberculosis
  CDS (4)..(1584)
taggccattcaacgctctgttcgtttgattggtcggtgggatgcgaaagctgcgcggcgacaggcgcggtctaatctgggcgcgatggtgaacaaatccaggatgatgccggcggtgctggccgtggctgtggtcgtcgcattcctgacgacgggctgtatccggtggtctacgcagtcgcggcccgttgttaacggccccgctgccgcagagttcgccgttgcgttgcgcaaccgggtgagcaccgacgcgatgatggcgcacctatcgaaactgcaggacatcgccaacgccaacgacggcactcgcgcggtgggcacccctggctatcaggccagcgtcgactatgtggtaaacacactgcgcaacagcggttttgatgtgcaaaccccggagttctccgctcgcgtgttcaaggccgaaaaaggggtggtgaccctcggcggcaacaccgtggaggcgagggcgctcgagtacagcctcggcacaccgccggacggggtgacgggcccgctggtggctgcccccgccgacgacagtccgggctgcagtccgtcggactacgacaggctgccggtgtccggtgcggtggtgctggtagatcgcggcgtctgtccttttgcccagaaggaagacgcagccgcgcagcgcggtgcggtggcgctgatcattgctgacaacatcgacgagcaggcgatgggcggcaccctgggggctaataccgacgtcaagatcccggtggtgagtgtcaccaagtcggtcggattccagctacgcggacagtctgggccaaccaccgtcaagctcacggcgagcacccaaagtttcaaggcccgcaacgtcatcgcgcagacgaagacggggtcgtcggccaacgtggtgatggcaggtgcgcatttggacagcgttccggaaggacccggcatcaacgacaacggctcgggagtggctgcggttctggaaacggcagtgcagctggggaactcaccgcatgtgtccaacgcggtacggttcgccttctggggcgccgaggaattcggcctgattgggtcacgaaactacgtcgagtcgctggacatcgacgcgctcaaaggcatcgcgctgtatctgaacttcgacatgttggcgtcgccgaacccgggttacttcacctacgacggtgaccagtcgctgccgctagacgcccgcggtcagccggtggtgcccgaaggctcggccggtatcgagcgcacgttcgtcgcctatctgaagatggccggcaagaccgcgcaggacacctcgttcgacggtcggtccgactacgacggcttcacgctggcgggtatcccttcgggtggcctgttctccggcgctgaggtcaagaagtccgccgagcaagccgagctctggggcggcaccgccgacgagcctttcgatcccaactatcaccagaagacagacaccctggaccatatcgaccgcaccgcgctcggtatcaacggcgctggcgtcgcgtacgcggtgggtttgtatgcgcaggacctcggcggccccaacggggttccggtcatggcggaccgcacccgccacctgattgccaaaccgtga

SEQ ID NO: 432 - protein, 527 aa, Mycobacterium tuberculosis
AIQRSVRLIGRWDAKAARRQARSNLGAMVNKSRMMPAVLAVAVVVAFLTTGCIRWSTQSRPVVNGPAAAEFAVALRNRVSTDAMMAHLSKLQDIANANDGTRAVGTPGYQASVDYVVNTLRNSGFDVQTPEFSARVFKAEKGVVTLGGNTVEARALEYSLGTPPDGVTGPLVAAPADDSPGCSPSDYDRLPVSGAVVLVDRGVCPFAQKEDAAAQRGAVALIIADNIDEQAMGGTLGANTDVKIPVVSVTKSVGFQLRGQSGPTTVKLTASTQSFKARNVIAQTKTGSSANVVMAGAHLDSVPEGPGINDNGSGVAAVLETAVQLGNSPHVSNAVRFAFWGAEEFGLIGSRNYVESLDIDALKGIALYLNFDMLASPNPGYFTYDGDQSLPLDARGQPVVPEGSAGIERTFVAYLKMAGKTAQDTSFDGRSDYDGFTLAGIPSGGLFSGAEVKKSAEQAELWGGTADEPFDPNYHQKTDTLDHIDRTALGINGAGVAYAVGLYAQDLGGPNGVPVMADRTRHLIAKP

SEQ ID NO: 433 - DNA, 390 bp, Mycobacterium tuberculosis
  CDS (1)..(180)
  CDS (184)..(279)
  CDS (283)..(390)
cgagacagtggtgcgggacacttgagttcggctgctaacgacgccagagtcgcccgcttccgcggtgtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 434 - protein, 60 aa, Mycobacterium tuberculosis
RDSGAGHLSSAANDARVARFRGVGLTFGEGTADLRARNIVGRLATVGFDVGDDPSFMNRS

SEQ ID NO: 435 - protein, 32 aa, Mycobacterium tuberculosis
APRFAGCPGTAGTAALKLVAHGAGREEQWASS

SEQ ID NO: 436 - protein, 36 aa, Mycobacterium tuberculosis
PRSPRWSVRACSQPDAPTWSTGPPWLPTNPDHCIRI

SEQ ID NO: 437 - DNA, 389 bp, Mycobacterium tuberculosis
  CDS (1)..(21)
  CDS (25)..(168)
  CDS (172)..(387)
gagacagtggtgcgggacacttgagttcggctgctaacgacgccagagtcgcccgcttccgcggtgtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 438 - protein, 7 aa, Mycobacterium tuberculosis
ETVVRDT

SEQ ID NO: 439 - protein, 48 aa, Mycobacterium tuberculosis
VRLLTTPESPASAVWDSRSVRVQRTFEHAISWAGWQPSVSTLVTTPRS

SEQ ID NO: 440 - protein, 72 aa, Mycobacterium tuberculosis
IVLELPVLLDAQAPPVLLRLSLSHMVPAGRNSGQAASRARRAGRCVHARSRMHQRGRRDRRGCRQIRTTASG

SEQ ID NO: 441 - DNA, 388 bp, Mycobacterium tuberculosis
  CDS (1)..(33)
  CDS (37)..(81)
  CDS (85)..(150)
  CDS (154)..(228)
  CDS (232)..(387)
agacagtggtgcgggacacttgagttcggctgctaacgacgccagagtcgcccgcttccgcggtgtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 442 - protein, 11 aa, Mycobacterium tuberculosis
RQWCGTLEFGC

SEQ ID NO: 443 - protein, 15 aa, Mycobacterium tuberculosis
RRQSRPLPRCGTHVR

SEQ ID NO: 444 - protein, 22 aa, Mycobacterium tuberculosis
GYSGPSSTQYRGPAGNRRFRRW

SEQ ID NO: 445 - protein, 25 aa, Mycobacterium tuberculosis
RPLVHESFLSSPFCWMPRHRRYCCA

SEQ ID NO: 446 - protein, 52 aa, Mycobacterium tuberculosis
ACRTWCRQGGTVGKQLAALAALVGACMLAAGCTNVVDGTAVAADKSGPLHQD

SEQ ID NO: 447 - DNA, 325 bp, Mycobacterium tuberculosis
  CDS (1)..(18)
  CDS (22)..(87)
  CDS (91)..(165)
  CDS (169)..(324)
tgtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 448 - protein, 6 aa, Mycobacterium tuberculosis
CGTHVR

SEQ ID NO: 449 - protein, 22 aa, Mycobacterium tuberculosis
GYSGPSSTQYRGPAGNRRFRRW

SEQ ID NO: 450 - protein, 25 aa, Mycobacterium tuberculosis
RPLVHESFLSSPFCWMPRHRRYCCA

SEQ ID NO: 451 - protein, 52 aa, Mycobacterium tuberculosis; identical to SEQ ID NO: 446

SEQ ID NO: 452 - DNA, 324 bp, Mycobacterium tuberculosis
  CDS (1)..(114)
  CDS (118)..(213)
  CDS (217)..(324)
gtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 453 - protein, 38 aa, Mycobacterium tuberculosis
VGLTFGEGTADLRARNIVGRLATVGFDVGDDPSFMNRS

SEQ ID NO: 454 - protein, 32 aa, Mycobacterium tuberculosis; identical to SEQ ID NO: 435

SEQ ID NO: 455 - protein, 36 aa, Mycobacterium tuberculosis; identical to SEQ ID NO: 436

SEQ ID NO: 456 - DNA, 326 bp, Mycobacterium tuberculosis
  CDS (1)..(105)
  CDS (109)..(324)
gtgtgggactcacgttcggtgagggtacagcggaccttcgagcacgcaatatcgtgggccggctggcaaccgtcggtttcgacgttggtgacgacccctcgttcatgaatcgttcttgagctccccgttttgctggatgcccaggcaccgccggtactgctgcgcttaagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatc

SEQ ID NO: 457 - protein, 35 aa, Mycobacterium tuberculosis
VWDSRSVRVQRTFEHAISWAGWQPSVSTLVTTPRS

SEQ ID NO: 458 - protein, 72 aa, Mycobacterium tuberculosis; identical to SEQ ID NO: 440

SEQ ID NO: 459 - DNA, 714 bp, Mycobacterium tuberculosis
  CDS (1)..(711)
atgggcaagcagctagccgcgctcgccgcgctggtcggtgcgtgcatgctcgcagccggatgcaccaacgtggtcgacgggaccgccgtggctgccgacaaatccggaccactgcatcaggatccgataccggtttcagcgcttgaagggctgcttctcgacttgagccagatcaatgccgcgctgggtgcgacatcgatgaaggtgtggttcaacgccaaggcaatgtgggactggagcaagagcgtggccgacaagaattgcctggctatcgacggtccagcacaggaaaaggtctatgccggcaccgggtggaccgctatgcgcggccaacggctggatgacagcatcgatgactccaagaaacgcgaccactacgccattcaagcggtcgtcggcttcccgaccgcacatgatgccgaggagttctacagctcctcggtgcaaagctggagcagctgctcgaaccgccggtttgtcgaagtcacccccggacaggacgacgccgcctggactgtggctgacgttgtcaacgacaacggcatgctcagtagctcgcaggttcaggaaggcggcgacggatggacctgccagcgtgccctgactgcgcgcaacaacgtcactatcgacattgtcacgtgcgcctatagccaaccggatttggtggcgattggcatcgctaaccaaatcgcggccaaggttgctaagcagtag

SEQ ID NO: 460 - protein, 237 aa, Mycobacterium tuberculosis
MGKQLAALAALVGACMLAAGCTNVVDGTAVAADKSGPLHQDPIPVSALEGLLLDLSQINAALGATSMKVWFNAKAMWDWSKSVADKNCLAIDGPAQEKVYAGTGWTAMRGQRLDDSIDDSKKRDHYAIQAVVGFPTAHDAEEFYSSSVQSWSSCSNRRFVEVTPGQDDAAWTVADVVNDNGMLSSSQVQEGGDGWTCQRALTARNNVTIDIVTCAYSQPDLVAIGIANQIAAKVAKQ

SEQ ID NO: 461 - DNA, 750 bp, Mycobacterium tuberculosis
  CDS (4)..(747)
taagcttgtcgcacatggtgccggcagggaggaacagtgggcaagcagctagccgcgctcgccgcgctggtcggtgcgtgcatgctcgcagccggatgcaccaacgtggtcgacgggaccgccgtggctgccgacaaatccggaccactgcatcaggatccgataccggtttcagcgcttgaagggctgcttctcgacttgagccagatcaatgccgcgctgggtgcgacatcgatgaaggtgtggttcaacgccaaggcaatgtgggactggagcaagagcgtggccgacaagaattgcctggctatcgacggtccagcacaggaaaaggtctatgccggcaccgggtggaccgctatgcgcggccaacggctggatgacagcatcgatgactccaagaaacgcgaccactacgccattcaagcggtcgtcggcttcccgaccgcacatgatgccgaggagttctacagctcctcggtgcaaagctggagcagctgctcgaaccgccggtttgtcgaagtcacccccggacaggacgacgccgcctggactgtggctgacgttgtcaacgacaacggcatgctcagtagctcgcaggttcaggaaggcggcgacggatggacctgccagcgtgccctgactgcgcgcaacaacgtcactatcgacattgtcacgtgcgcctatagccaaccggatttggtggcgattggcatcgctaaccaaatcgcggccaaggttgctaagcagtag

SEQ ID NO: 462 - protein, 248 aa, Mycobacterium tuberculosis
ACRTWCRQGGTVGKQLAALAALVGACMLAAGCTNVVDGTAVAADKSGPLHQDPIPVSALEGLLLDLSQINAALGATSMKVWFNAKAMWDWSKSVADKNCLAIDGPAQEKVYAGTGWTAMRGQRLDDSIDDSKKRDHYAIQAVVGFPTAHDAEEFYSSSVQSWSSCSNRRFVEVTPGQDDAAWTVADVVNDNGMLSSSQVQEGGDGWTCQRALTARNNVTIDIVTCAYSQPDLVAIGIANQIAAKVAKQ

SEQ ID NO: 463 - DNA, 390 bp, Mycobacterium tuberculosis
  CDS (1)..(66)
  CDS (70)..(81)
  CDS (85)..(153)
  CDS (157)..(318)
  CDS (322)..(390)
gtcctggtcgccgcgcaactggccggtcccgatggaaagtgttcacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 464 - protein, 22 aa, Mycobacterium tuberculosis
VLVAAQLAGPDGKCSRSRFCRW

SEQ ID NO: 465 - protein, 4 aa, Mycobacterium tuberculosis
WRWC

SEQ ID NO: 466 - protein, 23 aa, Mycobacterium tuberculosis
QDCGSRLRWPAPAACGWSPRAPK

SEQ ID NO: 467 - protein, 54 aa, Mycobacterium tuberculosis
YPRSRNTCRRWTSPCWPARPDTMWRGRRKTSPPASTSCRRDWPTPTSSQTCGRE

SEQ ID NO: 468 - protein, 23 aa, Mycobacterium tuberculosis
TRCSTAVRRCWIRCWPTASACGI

SEQ ID NO: 469 - DNA, 389 bp, Mycobacterium tuberculosis
  CDS (1)..(354)
  CDS (358)..(387)
tcctggtcgccgcgcaactggccggtcccgatggaaagtgttcacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 470 - protein, 118 aa, Mycobacterium tuberculosis
SWSPRNWPVPMESVHDRASAAGSGDGVSRIAGRGCDGQHQRPAAGRRARRNDTRDHEIHVGAGRRRAGQLDRTRCGGGAEKLHRPQVRAADATGRHRRHRRRAVGSEHAAQRRSGAAG

SEQ ID NO: 471 - protein, 10 aa, Mycobacterium tuberculosis
DAGRQHRLAG

SEQ ID NO: 472 - DNA, 388 bp, Mycobacterium tuberculosis
  CDS (1)..(387)
cctggtcgccgcgcaactggccggtcccgatggaaagtgttcacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 473 - protein, 129 aa, Mycobacterium tuberculosis
PGRRATGRSRWKVFTIALLPLVVAMVLAGLRVEAAMASTSGLRLVAARAEMIPAITKYMSALDVAVLASSTGHDVEGAQKNFTARKYELQTRLADTDVIADVRSGVNTLLNGGQALLDKMLADSIGLRD

SEQ ID NO: 474 - DNA, 346 bp, Mycobacterium tuberculosis
  CDS (1)..(345)
acgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 475 - protein, 115 aa, Mycobacterium tuberculosis
TIALLPLVVAMVLAGLRVEAAMASTSGLRLVAARAEMIPAITKYMSALDVAVLASSTGHDVEGAQKNFTARKYELQTRLADTDVIADVRSGVNTLLNGGQALLDKMLADSIGLRD

SEQ ID NO: 476 - DNA, 345 bp, Mycobacterium tuberculosis
  CDS (1)..(21)
  CDS (25)..(36)
  CDS (40)..(108)
  CDS (112)..(273)
  CDS (277)..(345)
cgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 477 - protein, 7 aa, Mycobacterium tuberculosis
RSRFCRW

SEQ ID NO: 478 - protein, 4 aa, Mycobacterium tuberculosis
WRWC

SEQ ID NO: 479 - protein, 23 aa, Mycobacterium tuberculosis
QDCGSRLRWPAPAACGWSPRAPK

SEQ ID NO: 480 - protein, 54 aa, Mycobacterium tuberculosis; identical to SEQ ID NO: 467

SEQ ID NO: 481 - protein, 23 aa, Mycobacterium tuberculosis
TRCSTAVRRCWIRCWPTASACGI

SEQ ID NO: 482 - DNA, 347 bp, Mycobacterium tuberculosis
  CDS (1)..(312)
  CDS (316)..(345)
cacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataagatgctggccgacagcatcggcttgcgggatc

SEQ ID NO: 483 - protein, 104 aa, Mycobacterium tuberculosis
HDRASAAGSGDGVSRIAGRGCDGQHQRPAAGRRARRNDTRDHEIHVGAGRRRAGQLDRTRCGGGAEKLHRPQVRAADATGRHRRHRRRAVGSEHAAQRRSGAAG

SEQ ID NO: 484 - protein, 10 aa, Mycobacterium tuberculosis
DAGRQHRLAG

SEQ ID NO: 485 - DNA, 2631 bp, Mycobacterium tuberculosis
  CDS (1)..(2628)
gtgaccatgttcgcccgcccgaccatcccggtcgcggcggccgcttctgatatttccgccccggctcaaccggcccgcggcaaacctcagcaacgcccgccgtcctggtcgccgcgcaactggccggtccgatggaaagtgttcacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataaggtgctggccgacagcatcggcttgcgggatcgggtcaccgcctacgcgccgctgctgttgacggcccagaacgtgattgacgcgtcggtgcgggttgacagcgagcaaatccgaacccaggtgcagggtttgagccgagccgttggcgcccgcgggcagatgacgatgcaggagatcctggtgactcgcggcgccgaccttgccgagccgcaactgcgcagcgcgatggttaccctggccggcaccgaaccctcgacgctgttcgggatgagcgcggcgctcggtgcaggctcgccggacaccaagaacctgcagcagcaaatggtgaccaggatggcgatcatgtccgatccggccgttgcactggtcaacaacccagagctgctgcactcgatacagatcacccgcgacattgccgagcaggtgatcaccgacaccaccgaggcggtgacgaagtcggtgcaaagccaggccaccgaccggcgggatgccgcgattcgcgacgccgtgctggtgttggccgccatcgcgaccgcgatcgtcgtcgtgttggtggtggcgcgcacgctggtcgggccgatgcgggtactgcgtgatggggcgctcaaggttgctcataccgatctcgacggcgagatcgcggcggtccgcgccggcgacgagccgatccccgagccactggcggtgtacaccaccgaggaaatcggtcaggtcgcgcatgcggtcgacgagctgcacacccgggccctgttgctggccggcgaggaaacgcggttgcgactgctggtcaacgagatgtttgagaccatgtcgcggcgtagccgttccctggtcgaccagcagctgtcggtcatcgaccaactggagcgcaacgaggaggatcccgcccgactcgacagccttttccggctcgatcacctggccgcccggctgcgccgcaacagcgccaacctgctggtgctggccggtgcgcagattacccgtgaccaccgcgagccggtgccgctgtcaaccgtgatcagcgccgccgtgtcagaggtcgaggactatcgccgcgtcgacatcgcgagggtacccgactgtgcggtagtcggcgcagcggctggtggcgtcattcatctgcttgccgagctgatcgacaacgcgttgcgctactcgtcaccgaccacacccgttcgggttgccgccgcaatcggcagcgaaggcagtgttctgctgcgaatctcggattccggcctgggcatgaccgatgccgatcggcggatggccaatatgcggctgcgggccggcggtgaggtcaccccggatagtgcccggcacatgggtctgttcgtagtcggccggctggccggtcggcacggcatccgagtcgggctgcgcggtccggtgaccggtgaacagggcaccggcaccaccgccgaggtctacctgccgctagccgtgctcgaggggacggccccagcgcagccgccaaagccgcgggtatttgcgatcaagccgccgtgtcctgaacccgcggcggccgatccgacggacgttcccgccgccatcgggccgctaccaccggtcacgttgctcccgcgccgtaccccggggtccagtggcatcgccgacgtcccggcccagccgatgcagcagcggcggcgcgagctgaaaacaccctggtgggaggataggtttcaacaggagcccaaacaaccgcccgcaccagaaccgcgaccggcgccgccgcccgccaaacccgcgccaccggcgggcccggttgatgacgacgtcatctaccggcggatgctctccgagatggtgggtgacccgcacgagctggcccacagccccgatctggactggaagtcggtgtgggaccacggctggtcggcggccgccgaggccgcggacaagcccgtgcagtcccgcacggactacggcctgccggtgcgcgaacccggggcccggttagtgccgggggcggcggtgcctgagggacccgatcgggagcatccgggtgcagcgctagcatccaacggcggacttcatcccggccgagcgccgcggcacgcggctgcggtacgcgaccccgacgcggttcgtgcctccatcagcagccatttcggcggcgtgcgcaccgggcggtcgcatgcccgcgagagcagtcagggacccaatcagcaatga

SEQ ID NO: 486 - protein, 876 aa, Mycobacterium tuberculosis
VTMFARPTIPVAAAASDISAPAQPARGKPQQRPPSWSPRNWPVRWKVFTIALLPLVVAMVLAGLRVEAAMASTSGLRLVAARAEMIPAITKYMSALDVAVLASSTGHDVEGAQKNFTARKYELQTRLADTDVIADVRSGVNTLLNGGQALLDKVLADSIGLRDRVTAYAPLLLTAQNVIDASVRVDSEQIRTQVQGLSRAVGARGQMTMQEILVTRGADLAEPQLRSAMVTLAGTEPSTLFGMSAALGAGSPDTKNLQQQMVTRMAIMSDPAVALVNNPELLHSIQITRDIAEQVITDTTEAVTKSVQSQATDRRDAAIRDAVLVLAAIATAIVVVLVVARTLVGPMRVLRDGALKVAHTDLDGEIAAVRAGDEPIPEPLAVYTTEEIGQVAHAVDELHTRALLLAGEETRLRLLVNEMFETMSRRSRSLVDQQLSVIDQLERNEEDPARLDSLFRLDHLAARLRRNSANLLVLAGAQITRDHREPVPLSTVISAAVSEVEDYRRVDIARVPDCAVVGAAAGGVIHLLAELIDNALRYSSPTTPVRVAAAIGSEGSVLLRISDSGLGMTDADRRMANMRLRAGGEVTPDSARHMGLFVVGRLAGRHGIRVGLRGPVTGEQGTGTTAEVYLPLAVLEGTAPAQPPKPRVFAIKPPCPEPAAADPTDVPAAIGPLPPVTLLPRRTPGSSGIADVPAQPMQQRRRELKTPWWEDRFQQEPKQPPAPEPRPAPPPAKPAPPAGPVDDDVIYRRMLSEMVGDPHELAHSPDLDWKSVWDHGWSAAAEAADKPVQSRTDYGLPVREPGARLVPGAAVPEGPDREHPGAALASNGGLHPGRAPRHAAAVRDPDAVRASISSHFGGVRTGRSHARESSQGPNQQ

SEQ ID NO: 487 - DNA, 2664 bp, Mycobacterium tuberculosis
  CDS (4)..(2661)
taagggtgcggccggtggcacggccgcggccacgtgaccatgttcgcccgcccgaccatcccggtcgcggcggccgcttctgatatttccgccccggctcaaccggcccgcggcaaacctcagcaacgcccgccgtcctggtcgccgcgcaactggccggtccgatggaaagtgttcacgatcgcgcttctgccgctggtagtggcgatggtgttagcaggattgcgggtcgaggctgcgatggccagcaccagcggcctgcggctggtcgccgcgcgcgccgaaatgatacccgcgatcacgaaatacatgtcggcgctggacgtcgccgtgctggccagctcgaccggacacgatgtggagggggcgcagaaaaacttcaccgcccgcaagtacgagctgcagacgcgactggccgacaccgacgtcatcgcagacgtgcggtcgggagtgaacacgctgctcaacggcggtcaggcgctgctggataaggtgctggccgacagcatcggcttgcgggatcgggtcaccgcctacgcgccgctgctgttgacggcccagaacgtgattgacgcgtcggtgcgggttgacagcgagcaaatccgaacccaggtgcagggtttgagccgagccgttggcgcccgcgggcagatgacgatgcaggagatcctggtgactcgcggcgccgaccttgccgagccgcaactgcgcagcgcgatggttaccctggccggcaccgaaccctcgacgctgttcgggatgagcgcggcgctcggtgcaggctcgccggacaccaagaacctgcagcagcaaatggtgaccaggatggcgatcatgtccgatccggccgttgcactggtcaacaacccagagctgctgcactcgatacagatcacccgcgacattgccgagcaggtgatcaccgacaccaccgaggcggtgacgaagtcggtgcaaagccaggccaccgaccggcgggatgccgcgattcgcgacgccgtgctggtgttggccgccatcgcgaccgcgatcgtcgtcgtgttggtggtggcgcgcacgctggtcgggccgatgcgggtactgcgtgatggggcgctcaaggttgctcataccgatctcgacggcgagatcgcggcggtccgcgccggcgacgagccgatccccgagccactggcggtgtacaccaccgaggaaatcggtcaggtcgcgcatgcggtcgacgagctgcacacccgggccctgttgctggccggcgaggaaacgcggttgcgactgctggtcaacgagatgtttgagaccatgtcgcggcgtagccgttccctggtcgaccagcagctgtcggtcatcgaccaactggagcgcaacgaggaggatcccgcccgactcgacagccttttccggctcgatcacctggccgcccggctgcgccgcaacagcgccaacctgctggtgctggccggtgcgcagattacccgtgaccaccgcgagccggtgccgctgtcaaccgtgatcagcgccgccgtgtcagaggtcgaggactatcgccgcgtcgacatcgcgagggtacccgactgtgcggtagtcggcgcagcggctggtggcgtcattcatctgcttgccgagctgatcgacaacgcgttgcgctactcgtcaccgaccacacccgttcgggttgccgccgcaatcggcagcgaaggcagtgttctgctgcgaatctcggattccggcctgggcatgaccgatgccgatcggcggatggccaatatgcggctgcgggccggcggtgaggtcaccccggatagtgcccggcacatgggtctgttcgtagtcggccggctggccggtcggcacggcatccgagtcgggctgcgcggtccggtgaccggtgaacagggcaccggcaccaccgccgaggtctacctgccgctagccgtgctcgaggggacggccccagcgcagccgccaaagccgcgggtatttgcgatcaagccgccgtgtcctgaacccgcggcggccgatccgacggacgttcccgccgccatcgggccgctaccaccggtcacgttgctcccgcgccgtaccccggggtccagtggcatcgccgacgtcccggcccagccgatgcagcagcggcggcgcgagctgaaaacaccctggtgggaggataggtttcaacaggagcccaaacaaccgcccgcaccagaaccgcgaccggcgccgccgcccgccaaacccgcgccaccggcgggcccggttgatgacgacgtcatctaccggcggatgctctccgagatggtgggtgacccgcacgagctggcccacagccccgatctggactggaagtcggtgtgggaccacggctggtcggcggccgccgaggccgcggacaagcccgtgcagtcccgcacggactacggcctgccggtgcgcgaacccggggcccggttagtgccgggggcggcggtgcctgagggacccgatcgggagcatccgggtgcagcgctagcatccaacggcggacttcatcccggccgagcgccgcggcacgcggctgcggtacgcgaccccgacgcggttcgtgcctccatcagcagccatttcggcggcgtgcgcaccgggcggtcgcatgcccgcgagagcagtcagggacccaatcagcaatga

SEQ ID NO: 488 - protein, 886 aa, Mycobacterium tuberculosis
GCGRWHGRGHVTMFARPTIPVAAAASDISAPAQPARGKPQQRPPSWSPRNWPVRWKVFTIALLPLVVAMVLAGLRVEAAMASTSGLRLVAARAEMIPAITKYMSALDVAVLASSTGHDVEGAQKNFTARKYELQTRLADTDVIADVRSGVNTLLNGGQALLDKVLADSIGLRDRVTAYAPLLLTAQNVIDASVRVDSEQIRTQVQGLSRAVGARGQMTMQEILVTRGADLAEPQLRSAMVTLAGTEPSTLFGMSAALGAGSPDTKNLQQQMVTRMAIMSDPAVALVNNPELLHSIQITRDIAEQVITDTTEAVTKSVQSQATDRRDAAIRDAVLVLAAIATAIVVVLVVARTLVGPMRVLRDGALKVAHTDLDGEIAAVRAGDEPIPEPLAVYTTEEIGQVAHAVDELHTRALLLAGEETRLRLLVNEMFETMSRRSRSLVDQQLSVIDQLERNEEDPARLDSLFRLDHLAARLRRNSANLLVLAGAQITRDHREPVPLSTVISAAVSEVEDYRRVDIARVPDCAVVGAAAGGVIHLLAELIDNALRYSSPTTPVRVAAAIGSEGSVLLRISDSGLGMTDADRRMANMRLRAGGEVTPDSARHMGLFVVGRLAGRHGIRVGLRGPVTGEQGTGTTAEVYLPLAVLEGTAPAQPPKPRVFAIKPPCPEPAAADPTDVPAAIGPLPPVTLLPRRTPGSSGIADVPAQPMQQRRRELKTPWWEDRFQQEPKQPPAPEPRPAPPPAKPAPPAGPVDDDVIYRRMLSEMVGDPHELAHSPDLDWKSVWDHGWSAAAEAADKPVQSRTDYGLPVREPGARLVPGAAVPEGPDREHPGAALASNGGLHPGRAPRHAAAVRDPDAVRASISSHFGGVRTGRSHARESSQGPNQQ

SEQ ID NO: 489 - DNA, 420 bp, Mycobacterium tuberculosis
  CDS (1)..(120)
  CDS (124)..(192)
  CDS (196)..(333)
  CDS (337)..(381)
  CDS (385)..(420)
ctacgacaaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgcatccgggccgaaggtcgtcatcgacggtaaggaccagaacgtcaccgggtctgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgctcggcaaccaaggacggcagccactacaagatc

SEQ ID NO: 490 - protein, 40 aa, Mycobacterium tuberculosis
LRQGKGAQGEAWTDGRGSRSRHSGRRSFRMFKQQVDYRKR

SEQ ID NO: 491 - protein, 23 aa, Mycobacterium tuberculosis
DHDRGRHDGKPRRRIRAEGRHRR

SEQ ID NO: 492 - protein, 46 aa, Mycobacterium tuberculosis
GPERHRVCGVHNRGRQCQHRDRRGGDRHCRRAHRRQPSGGEVRWAR

SEQ ID NO: 493 - protein, 15 aa, Mycobacterium tuberculosis
RQRRHAGIHVGHRTG

SEQ ID NO: 494 - protein, 12 aa, Mycobacterium tuberculosis
RSATKDGSHYKI

SEQ ID NO: 495 - DNA, 419 bp, Mycobacterium tuberculosis
  CDS (1)..(417)
tacgacaaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgcatccgggccgaaggtcgtcatcgacggtaaggaccagaacgtcaccgggtctgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgctcggcaaccaaggacggcagccactacaagatc

SEQ ID NO: 496 - protein, 139 aa, Mycobacterium tuberculosis
YDKAKEHRVKRGLTVAVAGAAILVAGLSGCSSNKSTTGSGETTTAAGTTASPGAASGPKVVIDGKDQNVTGSVVCTTAAGNVNIAIGGAATGIAAVLTDGNPPEVKSVGLGNVNGVTLGYTSGTGQGNARQPRTAATTR

SEQ ID NO: 497 - DNA, 418 bp, Mycobacterium tuberculosis
  CDS (1)..(24)
  CDS (28)..(36)
  CDS (40)..(48)
  CDS (52)..(312)
  CDS (316)..(417)
acgacaaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgcatccgggccgaaggtcgtcatcgacggtaaggaccagaacgtcaccgggtctgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgctcggcaaccaaggacggcagccactacaagatc

SEQ ID NO: 498 - protein, 8 aa, Mycobacterium tuberculosis
TTRQRSTG

SEQ ID NO: 499 - protein, 87 aa, Mycobacterium tuberculosis
PEPPFWSQVFPDVQATSRLQEAVRPRPRQARRQAPAPHPGRRSSSTVRTRTSPGLWCAQPRPAMSTSRSAGRRPALPPCSPTATLRR

SEQ ID NO: 500 - protein, 34 aa, Mycobacterium tuberculosis
SPLGSVTSTASRWDTRRAPDRVTLGNQGRQPLQD

SEQ ID NO: 501 - DNA, 597 bp, Mycobacterium tuberculosis
  CDS (1)..(90)
  CDS (94)..(297)
  CDS (301)..(597)
gcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 502 - protein, 30 aa, Mycobacterium tuberculosis
AQPRPAMSTSRSAGRRPALPPCSPTATLRR

SEQ ID NO: 503 - protein, 68 aa, Mycobacterium tuberculosis
SPLGSVTSTASRWDTRRAPDRVTPRQPRTAATTRSQGEAWTDGRGSRSRHSGRRSFRMFKQQVDYRKR

SEQ ID NO: 504 - protein, 99 aa, Mycobacterium tuberculosis
DHDRGRHDGKPRRRSGPKVVIDGKDQNVTGSVVCTTAAGNVNIAIGGAATGIAAVLTDGNPPEVKSVGLGNVNGVTLGYTSGTGQGNASATKDGSHYKI

SEQ ID NO: 505 - DNA, 596 bp, Mycobacterium tuberculosis
  CDS (1)..(108)
  CDS (112)..(156)
  CDS (160)..(489)
  CDS (493)..(594)
cacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 506 - protein, 36 aa, Mycobacterium tuberculosis
HNRGRQCQHRDRRGGDRHCRRAHRRQPSGGEVRWAR

SEQ ID NO: 507 - protein, 15 aa, Mycobacterium tuberculosis
RQRRHAGIHVGHRTG

SEQ ID NO: 508 - protein, 110 aa, Mycobacterium tuberculosis
RLGNQGRQPLQDHRVKRGLTVAVAGAAILVAGLSGCSSNKSTTGSGETTTAAGTTASPGAAPGRRSSSTVRTRTSPAPWCAQPRPAMSTSRSAGRRPALPPCSPTATLRR

SEQ ID NO: 509 - protein, 34 aa, Mycobacterium tuberculosis
SPLGSVTSTASRWDTRRAPDRVTPRQPRTAATTR

SEQ ID NO: 510 - DNA, 595 bp, Mycobacterium tuberculosis
  CDS (1)..(201)
  CDS (205)..(213)
  CDS (217)..(225)
  CDS (229)..(366)
  CDS (370)..(507)
  CDS (511)..(594)
acaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatcacagggtgaagcgtggactgacggtcgcggtagccgcagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 511 - protein, 67 aa, Mycobacterium tuberculosis
TTAAGNVNIAIGGAATGIAAVLTDGNPPEVKSVGLGNVNGVTLGYTSGTGQGNASATKDGSHYKITG

SEQ ID NO: 512 - protein, 46 aa, Mycobacterium tuberculosis
PQPPFWSQVFPDVQATSRLQEAVRPRPRQARRQAPAPLRAEGRHRR

SEQ ID NO: 513 - protein, 46 aa, Mycobacterium tuberculosis
GPERHRLRGVHNRGRQCQHRDRRGGDRHCRRAHRRQPSGGEVRWAR

SEQ ID NO: 514 - protein, 15 aa, Mycobacterium tuberculosis
RQRRHAGIHVGHRTG

SEQ ID NO: 515 - protein, 12 aa, Mycobacterium tuberculosis
RLGNQGRQPLQD

SEQ ID NO: 516 - DNA, 420 bp, Mycobacterium tuberculosis
  CDS (1)..(20)
  CDS (24)..(420)
ctaacgacaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 517 - protein, 40 aa, Mycobacterium tuberculosis
LTTGKGAQGEAWTDGRGSRSRHSGRRSFRMFKQQVDYRKR

SEQ ID NO: 518 - protein, 99 aa, Mycobacterium tuberculosis; identical to SEQ ID NO: 504

SEQ ID NO: 519 - DNA, 419 bp, Mycobacterium tuberculosis
  CDS (4)..(417)
taacgacaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 520 - protein, 103 aa, Mycobacterium tuberculosis
RQAKEHRVKRGLTVAVAGAAILVAGLSGCSSNKSTTGSGETTTAAGTTASPGAAPGRRSSSTVRTRTSPAPWCAQPRPAMSTSRSAGRRPALPPCSPTATLRR

SEQ ID NO: 521 - protein, 34 aa, Mycobacterium tuberculosis; identical to SEQ ID NO: 509

SEQ ID NO: 522 - DNA, 418 bp, Mycobacterium tuberculosis
  CDS (1)..(24)
  CDS (28)..(36)
  CDS (40)..(48)
  CDS (52)..(189)
  CDS (193)..(330)
  CDS (334)..(378)
  CDS (382)..(417)
aacgacaggcaaaggagcacagggtgaagcgtggactgacggtcgcggtagccggagccgccattctggtcgcaggtctttccggatgttcaagcaacaagtcgactacaggaagcggtgagaccacgaccgcggcaggcacgacggcaagccccggcgccgctccgggccgaaggtcgtcatcgacggtaaggaccagaacgtcaccggctccgtggtgtgcacaaccgcggccggcaatgtcaacatcgcgatcggcggggcggcgaccggcattgccgccgtgctcaccgacggcaaccctccggaggtgaagtccgttgggctcggtaacgtcaacggcgtcacgctgggatacacgtcgggcaccggacagggtaacgcctcggcaaccaaggacggcagccactacaagatc

SEQ ID NO: 523 - protein, 8 aa, Mycobacterium tuberculosis
NDRQRSTG

SEQ ID NO: 524 - protein, 46 aa, Mycobacterium tuberculosis
PEPPFWSQVFPDVQATSRLQEAVRPRPRQARRQAPAPLRAEGRHRR

SEQ ID NO: 525 - protein, 46 aa, Mycobacterium tuberculosis; identical to SEQ ID NO: 513

SEQ ID NO: 526 - protein, 15 aa, Mycobacterium tuberculosis
RQRRHAGIHVGHRTG

SEQ ID NO: 527 - protein, 12 aa, Mycobacterium tuberculosis
RLGNQGRQPLQD

SEQ ID NO: 528 - DNA, 18 bp, Mycobacterium tuberculosis
acgcggcgcagcctgttg

SEQ ID NO: 529 - DNA, 18 bp, Mycobacterium tuberculosis
cgaccttgggattcgcct

SEQ ID NO: 530 - DNA, 451 bp, Mycobacterium tuberculosis
  CDS (1)..(33)
  CDS (37)..(42)
  CDS (46)..(57)
  CDS (61)..(450)
cctaccagcaagagcccagggcttcacaggacctaaaaggagtagcgcccatgggcttgatccaattttccttccgccccgtgcaataccatctgcaagaccagcgacggcccgtggttgcggtcgcgcagcttgcggaaacggggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccccgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 531 - protein, 11 aa, Mycobacterium tuberculosis
PTSKSPGLHRT

SEQ ID NO: 532 - protein, 4 aa, Mycobacterium tuberculosis
RPWA

SEQ ID NO: 533 - protein, 130 aa, Mycobacterium tuberculosis
SNFPSAPCNTICKTSDGPWLRSRSLRKRGMDPAVPLLPLDVVALHPSGGESHSDTGILKTSAECLQGSGEQPIITMYELNKSPPRDFQTFVVVSVEAEARLISQQAVSGSQHRCGDRGAVVGRVVVNDHD

SEQ ID NO: 534 - DNA, 450 bp, Mycobacterium tuberculosis
  CDS (1)..(294)
  CDS (298)..(450)
ctaccagcaagagcccagggcttcacaggacctaaaaggagtagcgcccatgggcttgatccaattttccttccgccccgtgcaataccatctgcaagaccagcgacggcccgtggttgcggtcgcgcagcttgcggaaacggggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccccgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 535 - protein, 98 aa, Mycobacterium tuberculosis
LPARAQGFTGPKRSSAHGLDPIFLPPRAIPSARPATARGCGRAACGNGVWTLPYRCCHLMSSLSTRRGAKAIPTLGSSKRRLSVCRAPGSSRSSPCTN

SEQ ID NO: 536 - protein, 51 aa, Mycobacterium tuberculosis
ISPPRATSRHLLWFRLRPRRGSFRSKRSPGRSIVAAIAAQSSDESSSTTTI

SEQ ID NO: 537 - DNA, 449 bp, Mycobacterium tuberculosis
  CDS (1)..(174)
  CDS (178)..(243)
  CDS (247)..(297)
  CDS (301)..(342)
  CDS (346)..(447)
taccagcaagagcccagggcttcacaggacctaaaaggagtagcgcccatgggcttgatccaattttccttccgccccgtgcaataccatctgcaagaccagcgacggcccgtggttgcggtcgcgcagcttgcggaaacggggtatggaccctgccgtaccgttgttgccacttgatgtcgtcgctctccacccgtcggggggcgaaagccattccgacactgggatcctcaaaacgtcggctgagtgtctgcagggctccggggagcagccgatcatcaccatgtacgaactgaataagtcccccccgcgcgacttccagacatttgttgtggtttcggttgaggccgaggcgaggctcatttcgcagcaagcggtctccgggtcgcagcatcgttgcggcgatcgcggcgcagtcgtcggacgagtcgtcgtcaacgaccacgatc

SEQ ID NO: 538 - protein, 58 aa, Mycobacterium tuberculosis
YQQEPRASQDLKGVAPMGLIQFSFRPVQYHLQDQRRPVVAVAQLAETGYGPCRTVVAT

SEQ ID NO: 539 - protein, 22 aa, Mycobacterium tuberculosis
CRRSPPVGGRKPFRHWDPQNVG

SEQ ID NO: 540 - protein, 17 aa, Mycobacterium tuberculosis
VSAGLRGAADHHHVRTE

SEQ ID NO: 541 - protein, 14 aa, Mycobacterium tuberculosis
VPPARLPDICCGFG

SEQ ID NO: 542 - protein, 34 aa, Mycobacterium tuberculosis; identical to SEQ ID NO: 71

SEQ ID NO: 543 - protein, 136 aa, Mycobacterium tuberculosis; identical to SEQ ID NO: 32

SEQ ID NO: 544 - DNA, 714 bp, Mycobacterium tuberculosis
gtgggcaagcagctagccgcgctcgccgcgctggtcggtgcgtgcatgctcgcagccggatgcaccaacgtggtcgacgggaccgccgtggctgccgacaaatccggaccactgcatcaggatccgataccggtttcagcgcttgaagggctgcttctcgacttgagccagatcaatgccgcgctgggtgcgacatcgatgaaggtgtggttcaacgccaaggcaatgtgggactggagcaagagcgtggccgacaagaattgcctggctatcgacggtccagcacaggaaaaggtctatgccggcaccgggtggaccgctatgcgcggccaacggctggatgacagcatcgatgactccaagaaacgcgaccactacgccattcaagcggtcgtcggcttcccgaccgcacatgatgccgaggagttctacagctcctcggtgcaaagctggagcagctgctcgaaccgccggtttgtcgaagtcacccccggacaggacgacgccgcctggactgtggctgacgttgtcaacgacaacggcatgctcagtagctcgcaggttcaggaaggcggcgacggatggacctgccagcgtgccctgactgcgcgcaacaacgtcactatcgacattgtcacgtgcgcctatagccaaccggatttggtggcgattggcatcgctaaccaaatcgcggccaaggttgctaagcagtag

SEQ ID NO: 545 - protein, 245 aa, Mycobacterium tuberculosis
MGKQLAALAALVGACMLAAGCTNVVDGTAVAADKSGPLHQDPIPVFTSALEGLLLDLSQINAALGATSMKVWFNAKAMWDWSKSVADKNCLAIDGPAQEKVYAGTGFTWTAMRGQRLDDSIDDSKKRDHYAIQAVVGFPTAHDAEEFYSSSVQSWSSCSNRRFVEVTFTPGQDDAAWTVADVVNDNGMLSSSQVQEGGDGWTCQRALTARNNVTIDIVTCAYSQPDLVFTAIGIANQIAAKVAKQ

SEQ ID NO: 546 - DNA, 220 bp, Mycobacterium tuberculosis
  CDS (1)..(54)
  CDS (58)..(99)
  CDS (104)..(219)
aggcgaatacccgcgagggcagcgcgacggcggccctgccggcgccgtggctgctgaacaacacatcccagccgcgcacgcttccggtatgcggcaggataaacgaccccaacagcacgaacaccaggattgcgacaaccaaagccctcgcgcctggctcgatttcgcgcgcaacgcggcgttctgccgcctcgatctcagcgcggagggcgtcgagatc

SEQ ID NO: 547 - protein, 18 aa, Mycobacterium tuberculosis
RRIPARAARRRPCRRRGC

SEQ ID NO: 548 - protein, 14 aa, Mycobacterium tuberculosis
TTHPSRARFRYAAG

SEQ ID NO: 549 - protein, 39 aa, Mycobacterium tuberculosis
TTPTARTPGLRQPKPSRLARFRAQRGVLPPRSQRGGRRD

SEQ ID NO: 550 - DNA, 219 bp, Mycobacterium tuberculosis
  CDS (1)..(219)
ggcgaatacccgcgagggcagcgcgacggcggccctgccggcgccgtggctgctgaacaacacatcccagccgcgcacgcttccggtatgcggcaggataaacgaccccaacagcacgaacaccaggattgcgacaaccaaagccctcgcgcctggctcgatttcgcgcgcaacgcggcgttctgccgcctcgatctcagcgcggagggcgtcgagatc

SEQ ID NO: 551 - protein, 73 aa, Mycobacterium tuberculosis
GEYPRGQRDGGPAGAVAAEQHIPAAHASGMRQDKRPQQHEHQDCDNQSPRAWLDFARNAAFCRLDLSAEGVEI

SEQ ID NO: 552 - DNA, 218 bp, Mycobacterium tuberculosis
  CDS (1)..(216)
gcgaatacccgcgagggcagcgcgacggcggccctgccggcgccgtggctgctgaacaacacatcccagccgcgcacgcttccggtatgcggcaggataaacgaccccaacagcacgaacaccaggattgcgacaaccaaagccctcgcgcctggctcgatttcgcgcgcaacgcggcgttctgccgcctcgatctcagcgcggagggcgtcgagatc

SEQ ID NO: 553 - protein, 72 aa, Mycobacterium tuberculosis
ANTREGSATAALPAPWLLNNTSQPRTLPVCGRINDPNSTNTRIATTKALAPGSISRATRRSAASISARRASR

SEQ ID NO: 554 - DNA, 813 bp, Mycobacterium tuberculosis
  CDS (4)..(810)
taaacgaccccaacagcacgaacaccaggattgcgacaaccaaagccctcgcgcctggctcgatttcgcgcgcaacgcggcgttctgccgcctcgatctcagcgcggagggcgtcgagatccccggcgtcgtgttcgtggctcatcatctgcatcctccgggcttggccgcgctgaccggcagcccgaccccaggcatgcccaggccgacggcgcgccccggctgcccggcggtgtgcgcgtcgccggcgcgggtgcggcggtgggtcaggacgccggcgtcggcgatgaggtggtgcggcgccgcttcggtgaccttcgtggtgatgacgtcgccgggacgcacgcgcggctggccggcggtgaagtgcaccaggcgcccgtcgcgcgcccgcccgctcatgcgcgccgtgacggtgtccttgcgcccttccccggtggccaccagcacctcgacggcctgcccgaccagggcgcggttggcttccagcgagatttgctcctgcagcgcgatcaggcgttcatagcgttcctgcacaacggctttcggcagctgtccgtcgagttgcgcggccggtgtcccgggccgcttggagtattggaaggtaaatgcggccgcgaagcgggcccggcgcaccacgtcgagcgtggccgcgaagtcctcttcggtctccccggggaaaccgacgatcagatcggtggtaatcgcggcatgcgggatggccgcccgcacgcgctcgatgatgccgaggtagcgctcggcacgataggaccgccgcatcgcgcgcaggatccggtcggatccggactgtag

SEQ ID NO: 555 - protein, 269 aa, Mycobacterium tuberculosis
TTPTARTPGLRQPKPSRLARFRAQRGVLPPRSQRGGRRDPRRRVRGSSSASSGLGRADRQPDPRHAQADGAPRLPGGVRVAGAGAAVGQDAGVGDEVVRRRFGDLRGDDVAGTHARLAGGEVHQAPVARPPAHARRDGVLAPFPGGHQHLDGLPDQGAVGFQRDLLLQRDQAFIAFLHNGFRQLSVELRGRCPGPLGVLEGKCGREAGPAHHVERGREVLFGLPGETDDQIGGNRGMRDGRPHALDDAEVALGTIGPPHRAQDPVGSGL

SEQ ID NO: 556 - DNA, 357 bp, Mycobacterium tuberculosis
  CDS (1)..(357)
agactggtgtacacggagaccaagctgaactcggcattctccttcggcgggcctaagtgtctagtgaaggtcattcagaaactgtcgggcttgagcatcaaccggttcatcgcgattgacttcgtcggtttcgcgcggatggtcgaggccctcggcggcgtcgaggtatgcagcaccaccccgttgcgggactacgaactgggcacggtgctggagcacgccggacgccaggtcattgacgggccgaccgcgctgaactatgtgcgcgctcgccaggtcaccaccgagagcaatggcgactacgggcgcatcaaacgccagcagttgtttttgtcgtcgctgctgcgttcgatgatc

SEQ ID NO: 557 - protein, 119 aa, Mycobacterium tuberculosis
RLVYTETKLNSAFSFGGPKCLVKVIQKLSGLSINRFIAIDFVGFARMVEALGGVEVCSTTPLRDYELGTVLEHAGRQVIDGPTALNYVRARQVTTESNGDYGRIKRQQLFLSSLLRSMI

SEQ ID NO: 558 - DNA, 356 bp, Mycobacterium tuberculosis
  CDS (1)..(24)
  CDS (28)..(60)
  CDS (67)..(90)
  CDS (94)..(252)
  CDS (256)..(351)
gactggtgtacacggagaccaagctgaactcggcattctccttcggcgggcctaagtgtctagtgaaggtcattcagaaactgtcgggcttgagcatcaaccggttcatcgcgattgacttcgtcggtttcgcgcggatggtcgaggccctcggcggcgtcgaggtatgcagcaccaccccgttgcgggactacgaactgggcacggtgctggagcacgccggacgccaggtcattgacgggccgaccgcgctgaactatgtgcgcgctcgccaggtcaccaccgagagcaatggcgactacgggcgcatcaaacgccagcagttgtttttgtcgtcgctgctgcgttcgatgatc

SEQ ID NO: 559 - protein, 8 aa, Mycobacterium tuberculosis
DWCTRRPS

SEQ ID NO: 560 - protein, 11 aa, Mycobacterium tuberculosis
TRHSPSAGLSV

SEQ ID NO: 561 - protein, 8 aa, Mycobacterium tuberculosis
RSFRNCRA

SEQ ID NO: 562 - protein, 53 aa, Mycobacterium tuberculosis
ASTGSSRLTSSVSRGWSRPSAASRYAAPPRCGTTNWARCWSTPDARSLTGRPR

SEQ ID NO: 563 - protein, 32 aa, Mycobacterium tuberculosis
TMCALARSPPRAMATTGASNASSCFCRRCCVR

SEQ ID NO: 564 - DNA, 355 bp, Mycobacterium tuberculosis
  CDS (1)..(51)
  CDS (55)..(114)
  CDS (118)..(234)
  CDS (238)..(354)
actggtgtacacggagaccaagctgaactcggcattctccttcggcgggcctaagtgtctagtgaaggtcattcagaaactgtcgggcttgagcatcaaccggttcatcgcgattgacttcgtcggtttcgcgcggatggtcgaggccctcggcggcgtcgaggtatgcagcaccaccccgttgcgggactacgaactgggcacggtgctggagcacgccggacgccaggtcattgacgggccgaccgcgctgaactatgtgcgcgctcgccaggtcaccaccgagagcaatggcgactacgggcgcatcaaacgccagcagttgtttttgtcgtcgctgctgcgttcgatgatc

SEQ ID NO: 565 - protein, 17 aa, Mycobacterium tuberculosis
TGVHGDQAELGILLRRA

SEQ ID NO: 566 - protein, 20 aa, Mycobacterium tuberculosis
VSSEGHSETVGLEHQPVHRD

SEQ ID NO: 567 - protein, 39 aa, Mycobacterium tuberculosis
LRRFRADGRGPRRRRGMQHHPVAGLRTGHGAGARRTPGH

SEQ ID NO: 568 - protein, 39 aa, Mycobacterium tuberculosis
RADRAELCARSPGHHREQWRLRAHQTPAVVFVVAAAFDD

SEQ ID NO: 569 - DNA, 2055 bp, Mycobacterium tuberculosis
  CDS (1)..(2052)
atgagtgacggcgagagcgccgcgccgtgggcacggctctccgagtcagcattccccgatggtgttgaccgatggatcacggtaccgcccgccacatgggtggcagcccagggtccgcgggacacccagaatgtcggctgtcatgccaccggcgccgttagtgtggccgatctgatcgccaggctcggccccgcttttcctgacctccccacgcaccgccatgtcgcccccgaacccgagccatccggccgcggcccgaaggtccacgacgacgccgacgaccagcaggacaccgaggctatcgccatcccggcccactcgctcgagttcctctcggagcttcccgacctccgggcagccaactatccgcgcgccgaccacgcccgccgtgaacccgagctacccggcaagcagctaaccggatcggctcgagtgcggccattgcggatccgccgaacgtcgcccgcgcccgccaagccagcgccgaactccggccggcgcccgatggtgctggccgcgcgctcgctggcggctctgtttgccgctctggcgttggcgctgaccggcggggcatggcagtggagcgcgtcgaagaacagccggctgaacatggtaagcgcgctcgacccgcattcgggcgacatcgtcaaccccagcgggcagcatggcgacgagaacttcttgctcgtcggtatggactctcgtgccggggcgaacgccaatatcggcgccggcgacgccgaggacgccggcggcgcacgttcggacaccgtcatgctggtcaacattccggccagccgcgagcgggtcgtcgcggtgtcgttcccccgcgacctggcgatcactccaatccaatgcgaggcgtggaaccccgagaccggtaagtacggacccatctacgacgagaagacgggaacgatgggtcccagactggtgtacacggagaccaagctgaactcggcattctccttcggcgggcctaagtgtctagtgaaggtcattcagaaactgtcgggcttgagcatcaaccggttcatcgcgattgacttcgtcggtttcgcgcggatggtcgaggccctcggcggcgtcgaggtatgcagcaccaccccgttgcgggactacgaactgggcacggtgctggagcacgccggacgccaggtcattgacgggccgaccgcgctgaactatgtgcgcgctcgccaggtcaccaccgagagcaatggcgactacgggcgcatcaaacgccagcagttgtttttgtcgtcgctgctgcgttcgatgatctcgacggacaccttgttcaacctcagcaggctcaacaacgtcgtcaacatgttcatcggtaacagctacgtggacaacgtcaagaccaaagacctggtcgaactcggtcgatcgttgcagcatatggcggccgggcacgtcacgttcgtgaccgttccgaccggtataaccgaccagaacggcgacgagcccccgcgtacctccgacatgaaggcgcttttcaccgccatcatcgacgacgatccgctgcccctggaaaacgatcacaacgcccagcgtctgggcaacacgccgtcgaccccgccgaccaccaccaagaaggcgccgcaggcgggtctgaccaacgagattcagcaccagcaggttacgacgacctcgccaaaagaggtcacagtgcaggtctctaactcgaccggccaggccggtttggccaccaccgccaccgatcagctcaagcggaacggcttcaacgtgatggctccggacgactacccgagttcgctgctggccaccacagtgtttttttcgcccggcaacgaacaggctgccgccaccgtggccgccgtgttcggccagtcaaagatcgagcgggtgaccgggatcggccaactggtccaggtggtgctgggccaagacttcagcgcggtgcgcgctcccctgccgagtggctccaccgtcagcgtgcagataagccgcaactcctccagcccaccgaccaagctgcccgaggacctgacggtcaccaacgccgccgacaccacctgcgagtag

SEQ ID NO: 570 - protein, 684 aa, Mycobacterium tuberculosis
MSDGESAAPWARLSESAFPDGVDRWITVPPATWVAAQGPRDTQNVGCHATGAVSVADLIARLGPAFPDLPTHRHVAPEPEPSGRGPKVHDDADDQQDTEAIAIPAHSLEFLSELPDLRAANYPRADHARREPELPGKQLTGSARVRPLRIRRTSPAPAKPAPNSGRRPMVLAARSLAALFAALALALTGGAWQWSASKNSRLNMVSALDPHSGDIVNPSGQHGDENFLLVGMDSRAGANANIGAGDAEDAGGARSDTVMLVNIPASRERVVAVSFPRDLAITPIQCEAWNPETGKYGPIYDEKTGTMGPRLVYTETKLNSAFSFGGPKCLVKVIQKLSGLSINRFIAIDFVGFARMVEALGGVEVCSTTPLRDYELGTVLEHAGRQVIDGPTALNYVRARQVTTESNGDYGRIKRQQLFLSSLLRSMISTDTLFNLSRLNNVVNMFIGNSYVDNVKTKDLVELGRSLQHMAAGHVTFVTVPTGITDQNGDEPPRTSDMKALFTAIIDDDPLPLENDHNAQRLGNTPSTPPTTTKKAPQAGLTNEIQHQQVTTTSPKEVTVQVSNSTGQAGLATTATDQLKRNGFNVMAPDDYPSSLLATTVFFSPGNEQAAATVAAVFGQSKIERVTGIGQLVQVVLGQDFSAVRAPLPSGSTVSVQISRNSSSPPTKLPEDLTVTNAADTTCE

SEQ ID NO: 571 - DNA, 2061 bp, Mycobacterium tuberculosis
  CDS (4)..(2058)
taggacatgagtgacggcgagagcgccgcgccgtgggcacggctctccgagtcagcattccccgatggtgttgaccgatggatcacggtaccgcccgccacatgggtggcagcccagggtccgcgggacacccagaatgtcggctgtcatgccaccggcgccgttagtgtggccgatctgatcgccaggctcggccccgcttttcctgacctccccacgcaccgccatgtcgcccccgaacccgagccatccggccgcggcccgaaggtccacgacgacgccgacgaccagcaggacaccgaggctatcgccatcccggcccactcgctcgagttcctctcggagcttcccgacctccgggcagccaactatccgcgcgccgaccacgcccgccgtgaacccgagctacccggcaagcagctaaccggatcggctcgagtgcggccattgcggatccgccgaacgtcgcccgcgcccgccaagccagcgccgaactccggccggcgcccgatggtgctggccgcgcgctcgctggcggctctgtttgccgctctggcgttggcgctgaccggcggggcatggcagtggagcgcgtcgaagaacagccggctgaacatggtaagcgcgctcgacccgcattcgggcgacatcgtcaaccccagcgggcagcatggcgacgagaacttcttgctcgtcggtatggactctcgtgccggggcgaacgccaatatcggcgccggcgacgccgaggacgccggcggcgcacgttcggacaccgtcatgctggtcaacattccggccagccgcgagcgggtcgtcgcggtgtcgttcccccgcgacctggcgatcactccaatccaatgcgaggcgtggaaccccgagaccggtaagtacggacccatctacgacgagaagacgggaacgatgggtcccagactggtgtacacggagaccaagctgaactcggcattctccttcggcgggcctaagtgtctagtgaaggtcattcagaaactgtcgggcttgagcatcaaccggttcatcgcgattgacttcgtcggtttcgcgcggatggtcgaggccctcggcggcgtcgaggtatgcagcaccaccccgttgcgggactacgaactgggcacggtgctggagcacgccggacgccaggtcattgacgggccgaccgcgctgaactatgtgcgcgctcgccaggtcaccaccgagagcaatggcgactacgggcgcatcaaacgccagcagttgtttttgtcgtcgctgctgcgttcgatgatctcgacggacaccttgttcaacctcagcaggctcaacaacgtcgtcaacatgttcatcggtaacagctacgtggacaacgtcaagaccaaagacctggtcgaactcggtcgatcgttgcagcatatggcggccgggcacgtcacgttcgtgaccgttccgaccggtataaccgaccagaacggcgacgagcccccgcgtacctccgacatgaaggcgcttttcaccgccatcatcgacgacgatccgctgcccctggaaaacgatcacaacgcccagcgtctgggcaacacgccgtcgaccccgccgaccaccaccaagaaggcgccgcaggcgggtctgaccaacgagattcagcaccagcaggttacgacgacctcgccaaaagaggtcacagtgcaggtctctaactcgaccggccaggccggtttggccaccaccgccaccgatcagctcaagcggaacggcttcaacgtgatggctccggacgactacccgagttcgctgctggccaccacagtgtttttttcgcccggcaacgaacaggctgccgccaccgtggccgccgtgttcggccagtcaaagatcgagcgggtgaccgggatcggccaactggtccaggtggtgctgggccaagacttcagcgcggtgcgcgctcccctgccgagtggctccaccgtcagcgtgcagataagccgcaactcctccagcccaccgaccaagctgcccgaggacctgacggtcaccaacgccgccgacaccacctgcgagtag

SEQ ID NO: 572 - protein, 685 aa, Mycobacterium tuberculosis
DMSDGESAAPWARLSESAFPDGVDRWITVPPATWVAAQGPRDTQNVGCHATGAVSVADLIARLGPAFPDLPTHRHVAPEPEPSGRGPKVHDDADDQQDTEAIAIPAHSLEFLSELPDLRAANYPRADHARREPELPGKQLTGSARVRPLRIRRTSPAPAKPAPNSGRRPMVLAARSLAALFAALALALTGGAWQWSASKNSRLNMVSALDPHSGDIVNPSGQHGDENFLLVGMDSRAGANANIGAGDAEDAGGARSDTVMLVNIPASRERVVAVSFPRDLAITPIQCEAWNPETGKYGPIYDEKTGTMGPRLVYTETKLNSAFSFGGPKCLVKVIQKLSGLSINRFIAIDFVGFARMVEALGGVEVCSTTPLRDYELGTVLEHAGRQVIDGPTALNYVRARQVTTESNGDYGRIKRQQLFLSSLLRSMISTDTLFNLSRLNNVVNMFIGNSYVDNVKTKDLVELGRSLQHMAAGHVTFVTVPTGITDQNGDEPPRTSDMKALFTAIIDDDPLPLENDHNAQRLGNTPSTPPTTTKKAPQAGLTNEIQHQQVTTTSPKEVTVQVSNSTGQAGLATTATDQLKRNGFNVMAPDDYPSSLLATTVFFSPGNEQAAATVAAVFGQSKIERVTGIGQLVQVVLGQDFSAVRAPLPSGSTVSVQISRNSSSPPTKLPEDLTVTNAADTTCE

SEQ ID NO: 573 - DNA, 214 bp, Mycobacterium tuberculosis
  CDS (1)..(156)
  CDS (160)..(213)
cgtcacctctgccatggtccatctacggtatctgcgacaagggcagcgtcgatccctcgacatgcagagtcggtgttcgcttcacgcgaactaggcgcgcctagcctggacgagtccccgggccgacattcgcccgaggccttggcctccatcacctaattgtgtgcaaaaccgtatctaattgatacgattgcgcacatggctatctgggatc

SEQ ID NO: 574 - protein, 52 aa, Mycobacterium tuberculosis
RHLCHGPSTVSATRAASIPRHAESVFASRELGAPSLDESPGRHSPEALASIT

SEQ ID NO: 575 - protein, 18 aa, Mycobacterium tuberculosis
LCAKPYLIDTIAHMAIWD

SEQ ID NO: 576 - DNA, 213 bp, Mycobacterium tuberculosis
  CDS (1)..(77)
  CDS (81)..(213)
gtcacctctgccatggtccatctacggtatctgcgacaagggcagcgtcgatccctcgacatgcagagtcggtgttcgcttcacgcgaactaggcgcgcctagcctggacgagtccccgggccgacattcgcccgaggccttggcctccatcacctaattgtgtgcaaaaccgtatctaattgatacgattgcgcacatggctatctgggatc

SEQ ID NO: 577 - protein, 30 aa, Mycobacterium tuberculosis
VTSAMVHLRYLRQGQRRSLDMQSRCSLHAN

SEQ ID NO: 578 - protein, 28 aa, Mycobacterium tuberculosis
ARLAWTSPRADIRPRPWPPSPNCVQNRI

SEQ ID NO: 579 - protein, 11 aa, Mycobacterium tuberculosis
LIRLRTWLSGI

SEQ ID NO: 580 - DNA, 215 bp, Mycobacterium tuberculosis
  CDS (1)..(102)
  CDS (106)..(183)
  CDS (187)..(213)
ccgtcacctctgccatggtccatctacggtatctgcgacaagggcagcgtcgatccctcgacatgcagagtcggtgttcgcttcacgcgaactaggcgcgcctagcctggacgagtccccgggccgacattcgcccgaggccttggcctccatcacctaattgtgtgcaaaaccgtatctaattgatacgattgcgcacatggctatctgggatc

SEQ ID NO: 581 - protein, 34 aa, Mycobacterium tuberculosis
PSPLPWSIYGICDKGSVDPSTCRVGVRFTRTRRA

SEQ ID NO: 582 - protein, 26 aa, Mycobacterium tuberculosis
PGRVPGPTFARGLGLHHLIVCKTVSN

SEQ ID NO: 583 - protein, 9 aa, Mycobacterium tuberculosis
YDCAHGYLG

SEQ ID NO: 584 - DNA, 624 bp, Mycobacterium tuberculosis
  CDS (1)..(621)
ttgtgtgcaaaaccgtatctaattgatacgattgcgcacatggctatctgggatcgcctcgtcgaggttgccgccgagcaacatggctacgtcacgactcgcgatgcgcgagacatcggcgtcgaccctgtgcagctccgcctcctagcggggcgcggacgtcttgagcgtgtcggccgaggtgtgtaccgggtgcccgtgctgccgcgtggtgagcacgacgatctcgcagccgcagtgtcgtggactttggggcgtggcgttatctcgcatgagtcggccttggcgcttcatgccctcgctgacgtgaacccgtcgcgcatccatctcaccgtcccgcgcaacaaccatccgcgtgcggccgggggcgagctgtaccgagttcaccgccgcgacctccaggcagcccacgtcacttcggtcgacggaatacccgtcacgacggttgcgcgcaccatcaaagactgcgtgaagacgggcacggatccttatcagcttcgggccgcgatcgagcgagccgaagccgagggcacgcttcgtcgtgggtcagcagctgagctacgcgctgcgctcgatgagaccactgccggattacgcgctcggccgaagcgagcatcggcgtga

SEQ ID NO: 585 - protein, 207 aa, Mycobacterium tuberculosis
LCAKPYLIDTIAHMAIWDRLVEVAAEQHGYVTTRDARDIGVDPVQLRLLAGRGRLERVGRGVYRVPVLPRGEHDDLAAAVSWTLGRGVISHESALALHALADVNPSRIHLTVPRNNHPRAAGGELYRVHRRDLQAAHVTSVDGIPVTTVARTIKDCVKTGTDPYQLRAAIERAEAEGTLRRGSAAELRAALDETTAGLRARPKRASA

SEQ ID NO: 586 - DNA, 627 bp, Mycobacterium tuberculosis
  CDS (4)..(624)
taattgtgtgcaaaaccgtatctaattgatacgattgcgcacatggctatctgggatcgcctcgtcgaggttgccgccgagcaacatggctacgtcacgactcgcgatgcgcgagacatcggcgtcgaccctgtgcagctccgcctcctagcggggcgcggacgtcttgagcgtgtcggccgaggtgtgtaccgggtgcccgtgctgccgcgtggtgagcacgacgatctcgcagccgcagtgtcgtggactttggggcgtggcgttatctcgcatgagtcggccttggcgcttcatgccctcgctgacgtgaacccgtcgcgcatccatctcaccgtcccgcgcaacaaccatccgcgtgcggccgggggcgagctgtaccgagttcaccgccgcgacctccaggcagcccacgtcacttcggtcgacggaatacccgtcacgacggttgcgcgcaccatcaaagactgcgtgaagacgggcacggatccttatcagcttcgggccgcgatcgagcgagccgaagccgagggcacgcttcgtcgtgggtcagcagctgagctacgcgctgcgctcgatgagaccactgccggattacgcgctcggccgaagcgagcatcggcgtga

SEQ ID NO: 587 - protein, 207 aa, Mycobacterium tuberculosis; identical to SEQ ID NO: 585

SEQ ID NO: 588 - DNA, 215 bp, Mycobacterium tuberculosis
  CDS (1)..(213)
atccaacctgctgggcctgcgccttcgaatcgacggccaggccaccgctcgctgccggcaacaacacctggaatggggaccttttcggtgttgctggtaaccgggacaaccggcaccacgcctcggtcgagacgtatcgcggcagcgttggccctgtcgttgctgacaattaccgctggccgccgcatatttgccgcgctgccgcgggccggatc

SEQ ID NO: 589 - protein, 71 aa, Mycobacterium tuberculosis
IQPAGPAPSNRRPGHRSLPATTPGMGTFSVLLVTGTTGTTPRSRRIAAALALSLLTITAGRRIFAALPRAG

SEQ ID NO: 590 - DNA, 214 bp, Mycobacterium tuberculosis
  CDS (1)..(96)
  CDS (100)..(162)
  CDS (166)..(213)
tccaacctgctgggcctgcgccttcgaatcgacggccaggccaccgctcgctgccggcaacaacacctggaatggggaccttttcggtgttgctggtaaccgggacaaccggcaccacgcctcggtcgagacgtatcgcggcagcgttggccctgtcgttgctgacaattaccgctggccgccgcatatttgccgcgctgccgcgggccggatc

SEQ ID NO: 591 - protein, 32 aa, Mycobacterium tuberculosis
SNLLGLRLRIDGQATARCRQQHLEWGPFRCCW

SEQ ID NO: 592 - protein, 21 aa, Mycobacterium tuberculosis
PGQPAPRLGRDVSRQRWPCRC

SEQ ID NO: 593 - protein, 16 aa, Mycobacterium tuberculosis
QLPLAAAYLPRCRGPD

SEQ ID NO: 594 - DNA, 216 bp, Mycobacterium tuberculosis
  CDS (1)..(216)
gatccaacctgctgggcctgcgccttcgaatcgacggccaggccaccgctcgctgccggcaacaacacctggaatggggaccttttcggtgttgctggtaaccgggacaaccggcaccacgcctcggtcgagacgtatcgcggcagcgttggccctgtcgttgctgacaattaccgctggccgccgcatatttgccgcgctgccgcgggccggatc

SEQ ID NO: 595 - protein, 72 aa, Mycobacterium tuberculosis
DPTCWACAFESTARPPLAAGNNTWNGDLFGVAGNRDNRHHASVETYRGSVGPVVADNYRWPPHICRAAAGRI

SEQ ID NO: 596 - DNA, 528 bp, Mycobacterium tuberculosis
  CDS (4)..(525)
tagccgcagggccctgcggctaggcgcggccggtgccgttggccgcggcggcaatcgatgttgcagcagttacaacgccaaatggagtctgagcgcatcgtcgagttcgatcagctcggcaggggagacgttgcgcagcgacggatccaacctgctgggcctgcgccttcgaatcgacggccaggccaccgctcgctgccggcaacaacacctggaatggggaccttttcggtgttgctggtaaccgggacaaccggcaccacgcctcggtcgagacgtatcgcggcagcgttggccctgtcgttgctgacaattaccgctggccgccgcatatttgccgcgctgccgcgggccggatccaggtcgacctgccagatctcaccgcgcagcatctacgccgttcgctgcaaaccgccgactgcgacggcaggcccactctcttggcatgcgtccaatgctgcgacgtcctcggtagacaagctcacgcttggcttcatgccgcagtcctacccatgtagtaacagatag

SEQ ID NO: 597 - protein, 174 aa, Mycobacterium tuberculosis
PQGPAARRGRCRWPRRQSMLQQLQRQMESERIVEFDQLGRGDVAQRRIQPAGPAPSNRRPGHRSLPATTPGMGTFSVLLVTGTTGTTPRSRRIAAALALSLLTITAGRRIFAALPRAGSRSTCQISPRSIYAVRCKPPTATAGPLSWHASNAATSSVDKLTLGFMPQSYPCSNR

SEQ ID NO: 598 - DNA, 403 bp, Mycobacterium tuberculosis
  CDS (1)..(402)
cagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 599 - protein, 134 aa, Mycobacterium tuberculosis
QSVGKEGRMPLSDHEQRMLDQIESALYAEDPKFASSVRGGGFRAPTARRRLQGAALFIIGLGMLVSGVAFKETMIGSFPILSVFGFVVMFGGVVYAITGPRLSGRMDRGGSAAGASRQRRTKGAGGSFTSRMED

SEQ ID NO: 600 - DNA, 405 bp, Mycobacterium tuberculosis
  CDS (1)..(222)
  CDS (226)..(264)
  CDS (268)..(405)
gacagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 601 - protein, 74 aa, Mycobacterium tuberculosis
DSLSARRDACHSPIMSSGCLTRSRALSTPKIPSSHRVSVAGASAHRPRGGACRARRCSSSVWGCWFPAWRSKRP

SEQ ID NO: 602 - protein, 13 aa, Mycobacterium tuberculosis
SEVSRYSAFSVLS

SEQ ID NO: 603 - protein, 46 aa, Mycobacterium tuberculosis
CSVVWCMPSPVLGCPAGWIVADRLLGLRASVVPRGPGAHSPAVWKI

SEQ ID NO: 604 - DNA, 404 bp, Mycobacterium tuberculosis
  CDS (1)..(42)
  CDS (46)..(57)
  CDS (61)..(402)
acagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 605 - protein, 14 aa, Mycobacterium tuberculosis
TVCRQGGTHATLRS

SEQ ID NO: 606 - protein, 4 aa, Mycobacterium tuberculosis
AADA

SEQ ID NO: 607 - protein, 114 aa, Mycobacterium tuberculosis
PDRERSLRRRSQVRIECPWRGLPRTDRAAAPAGRGVVHHRSGDVGFRRGVQRDHDRKFPDTQRFRFCRDVRWCGVCHHRSSVVRQDGSWRIGCWGFAPASYQGGRGLIHQPYGR

SEQ ID NO: 608 - DNA, 405 bp, Mycobacterium tuberculosis
  CDS (1)..(402)
atgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatcggttccggcgccgcttcgacgagtaa

SEQ ID NO: 609 - protein, 134 aa, Mycobacterium tuberculosis
MPLSDHEQRMLDQIESALYAEDPKFASSVRGGGFRAPTARRRLQGAALFIIGLGMLVSGVAFKETMIGSFPILSVFGFVVMFGGVVYAITGPRLSGRMDRGGSAAGASRQRRTKGAGGSFTSRMEDRFRRRFDE

SEQ ID NO: 610 - DNA, 432 bp, Mycobacterium tuberculosis
  CDS (4)..(429)
tgacagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatcggttccggcgccgcttcgacgagtaa

SEQ ID NO: 611 - protein, 142 aa, Mycobacterium tuberculosis
QSVGKEGRMPLSDHEQRMLDQIESALYAEDPKFASSVRGGGFRAPTARRRLQGAALFIIGLGMLVSGVAFKETMIGSFPILSVFGFVVMFGGVVYAITGPRLSGRMDRGGSAAGASRQRRTKGAGGSFTSRMEDRFRRRFDE

SEQ ID NO: 612 - DNA, 415 bp, Mycobacterium tuberculosis
  CDS (1)..(414)
gacctgggacgaagacgacggcagcagccgcaatcagatctacccggtcctggtcaacgtcaatggacacccgactacggtgcgcctgcgcggctcgacaatgcgcggttcctgttgcccgtggtcggagtgccacccgaccaggccaccgacttcggctccgctgttgcaccagaaacgacggcgccggtctggatcaccatgctgtggccgctggccgaccggccccggttggcccccggggcacccggtggcaccgttcccgtccggctggtcgacgacgacctggcaaactcgctggccaacggcggccggctggacatcctcctgtcggcggccgagttcgccaccaaccgggaagtcgaccccgacggcgccgtcggccgagcgctgtgcctggccatcgacccagatc

SEQ ID NO: 613 - protein, 138 aa, Mycobacterium tuberculosis
DLGRRRRQQPQSDLPGPGQRQWTPDYGAPARLDNARFLLPVVGVPPDQATDFGSAVAPETTAPVWITMLWPLADRPRLAPGAPGGTVPVRLVDDDLANSLANGGRLDILLSAAEFATNREVDPDGAVGRALCLAIDPD

SEQ ID NO: 614 - DNA, 414 bp, Mycobacterium tuberculosis
  CDS (1)..(414)
acctgggacgaagacgacggcagcagccgcaatcagatctacccggtcctggtcaacgtcaatggacacccgactacggtgcgcctgcgcggctcgacaatgcgcggttcctgttgcccgtggtcggagtgccacccgaccaggccaccgacttcggctccgctgttgcaccagaaacgacggcgccggtctggatcaccatgctgtggccgctggccgaccggccccggttggcccccggggcacccggtggcaccgttcccgtccggctggtcgacgacgacctggcaaactcgctggccaacggcggccggctggacatcctcctgtcggcggccgagttcgccaccaaccgggaagtcgaccccgacggcgccgtcggccgagcgctgtgcctggccatcgacccagatc

SEQ ID NO: 615 - protein, 138 aa, Mycobacterium tuberculosis
TWDEDDGSSRNQIYPVLVNVNGHPTTVRLRGSTMRGSCCPWSECHPTRPPTSAPLLHQKRRRRSGSPCCGRWPTGPGWPPGHPVAPFPSGWSTTTWQTRWPTAAGWTSSCRRPSSPPTGKSTPTAPSAERCAWPSTQI

SEQ ID NO: 616 - DNA, 413 bp, Mycobacterium tuberculosis
  CDS (1)..(411)
cctgggacgaagacgacggcagcagccgcaatcagatctacccggtcctggtcaacgtcaatggacacccgactacggtgcgcctgcgcggctcgacaatgcgcggttcctgttgcccgtggtcggagtgccacccgaccaggccaccgacttcggctccgctgttgcaccagaaacgacggcgccggtctggatcaccatgctgtggccgctggccgaccggccccggttggcccccggggcacccggtggcaccgttcccgtccggctggtcgacgacgacctggcaaactcgctggccaacggcggccggctggacatcctcctgtcggcggccgagttcgccaccaaccgggaagtcgaccccgacggcgccgtcggccgagcgctgtgcctggccatcgacccagatc

SEQ ID NO: 617 - protein, 137 aa, Mycobacterium tuberculosis
PGTKTTAAAAIRSTRSWSTSMDTRLRCACAARQCAVPVARGRSATRPGHRLRLRCCTRNDGAGLDHHAVAAGRPAPVGPRGTRWHRSRPAGRRRPGKLAGQRRPAGHPPVGGRVRHQPGSRPRRRRRPSAVPGHRPR

SEQ ID NO: 618 - DNA, 2409 bp, Mycobacterium tuberculosis
  CDS (1)..(2406)
gtgaccgcactgcaactcggctgggccgctttggcgcgcgtcacctcagcgatcggcgtcgtggccggcctcgggatggcgctcacggtaccgtcggcggcaccgcacgcgctcgcaggcgagcccagcccgacgccttttgtccaggtccgcatcgatcaggtgaccccggacgtggtgaccacttccagcgaaccccatgtcaccgtcagcggaacggtgaccaataccggtgaccgcccagtccgcgatgtgatggtccggcttgagcacgccgccgcggtcacgtcgtcaacggcgttacgcacctcgctcgacggcggcaccgaccagtaccagccggccgcggacttcctcacggtcgcccccgaactagaccgcgggcaagaggccggctttaccctctcggccccgctgcgctcgctgaccaggccgtcgttggccgtcaaccagcccgggatctacccggtcctggtcaacgtcaatgggacacccgactacggtgcgcctgcgcggctcgacaatgcgcggttcctgttgcccgtggtcggagtgccacccgaccaggccaccgacttcggctccgctgttgcaccagaaacgacggcgccggtctggatcaccatgctgtggccgctggccgaccggccccggttggcccccggggcacccggtggcaccgttcccgtccggctggtcgacgacgacctggcaaactcgctggccaacggcggccggctggacatcctcctgtcggcggccgagttcgccaccaaccgggaagtcgaccccgacggcgccgtcggccgagcgctgtgcctggccatcgacccagatctactcatcaccgtcaatgcgatgaccggcggctacgtcgtgtccgactcgcccgacggggccgctcaactaccgggcaccccgacccacccgggcaccggccaggccgccgcatccagctggctggatcgattgcggacgctagtccaccggacatgcgtgacgccgctgccttttgcccaagccgacctggatgctttgcagcgggttaatgatccgaggctgagcgcgatcgcaaccatcagccccgccgacatcgtcgaccgcatcctggatgtcagctccacccgcggcgcaaccgtgctgcccgacggcccgttgaccggccgggcgatcaacttgctcagcacccacggcaacacggttgccgtcgcggccgccgattttagccccgaggaacagcagggttcgtcccagatcggctccgcgctcttacccgctaccgcgccccggcggttgtccccgcgggtggtagcggcgccgtttgatcccgcggtcggggccgcgctggccgccgcgggaacaaacccgaccgttcctacctatctagatccctcgttgttcgttcggatcgcgcatgaatcgatcaccgcgcgccgccaggacgccttgggcgcaatgctgtggcgcagcttggagccgaatgccgcgccccgtacccaaatcctggtgccgccggcgtcgtggagcctggccagcgacgacgcgcaggtcatcctgaccgcgctggccaccgccatccggtctggcctggccgtgccgcgaccactaccggcggtgatcgctgacgccgcggcccgcaccgagccaccggaacccccgggcgcttacagcgccgctcgcggccggttcaatgacgacatcaccacgcagatcggcgggcaggttgcccggctatggaagctgacctcggcgttgaccatcgatgaccgcaccgggctgaccggcgtgcagtacaccgcaccactacgcgaggacatgttgcgcgcgctgagccaatcgctaccacccgatacccgcaacgggctggcccagcagcggctggccgtcgttggaaagacgatcgacgatcttttcggcgcggtgaccatcgtcaacccgggcggctcctacactctggccaccgagcacagtccgctgccgttggcgctgcataatggcctcgccgtgccaatccgggtccggctacaggtcgatgctccgcccgggatgacggtggccgatgtcggtcagatcgagctaccgcccgggtacctgccgctacgagtaccaatcgaggtgaacttcacacagcgggttgccgtcgacgtgtcgctgcggacccccgacggcgtcgcgctgggtgaaccggtgcggttgtcggtgcactccaacgcctacggcaaggtgttgttcgcgatcacgctatccgctgcggccgtgctggtaacgctggcgggccggcgcctttggcaccggttccgtggccagcctgatcgcgccgacctggatcgccccgacctgcctaccggcaaacacgccccgcagcgccgtgccgtagccagtcgggatgacgaaaagcaccgggtatga

SEQ ID NO: 619 - protein, 802 aa, Mycobacterium tuberculosis
VTALQLGWAALARVTSAIGVVAGLGMALTVPSAAPHALAGEPSPTPFVQVRIDQVTPDVVTTSSEPHVTVSGTVTNTGDRPVRDVMVRLEHAAAVTSSTALRTSLDGGTDQYQPAADFLTVAPELDRGQEAGFTLSAPLRSLTRPSLAVNQPGIYPVLVNVNGTPDYGAPARLDNARFLLPVVGVPPDQATDFGSAVAPETTAPVWITMLWPLADRPRLAPGAPGGTVPVRLVDDDLANSLANGGRLDILLSAAEFATNREVDPDGAVGRALCLAIDPDLLITVNAMTGGYVVSDSPDGAAQLPGTPTHPGTGQAAASSWLDRLRTLVHRTCVTPLPFAQADLDALQRVNDPRLSAIATISPADIVDRILDVSSTRGATVLPDGPLTGRAINLLSTHGNTVAVAAADFSPEEQQGSSQIGSALLPATAPRRLSPRVVAAPFDPAVGAALAAAGTNPTVPTYLDPSLFVRIAHESITARRQDALGAMLWRSLEPNAAPRTQILVPPASWSLASDDAQVILTALATAIRSGLAVPRPLPAVIADAAARTEPPEPPGAYSAARGRFNDDITTQIGGQVARLWKLTSALTIDDRTGLTGVQYTAPLREDMLRALSQSLPPDTRNGLAQQRLAVVGKTIDDLFGAVTIVNPGGSYTLATEHSPLPLALHNGLAVPIRVRLQVDAPPGMTVADVGQIELPPGYLPLRVPIEVNFTQRVAVDVSLRTPDGVALGEPVRLSVHSNAYGKVLFAITLSAAAVLVTLAGRRLWHRFRGQPDRADLDRPDLPTGKHAPQRRAVASRDDEKHRV

SEQ ID NO: 620 - DNA, 2451 bp, Mycobacterium tuberculosis
  CDS (4)..(2448)
tgactcagcaccgggtcagcacaacggtcccgggccggggccgtgaccgcactgcaactcggctgggccgctttggcgcgcgtcacctcagcgatcggcgtcgtggccggcctcgggatggcgctcacggtaccgtcggcggcaccgcacgcgctcgcaggcgagcccagcccgacgccttttgtccaggtccgcatcgatcaggtgaccccggacgtggtgaccacttccagcgaaccccatgtcaccgtcagcggaacggtgaccaataccggtgaccgcccagtccgcgatgtgatggtccggcttgagcacgccgccgcggtcacgtcgtcaacggcgttacgcacctcgctcgacggcggcaccgaccagtaccagccggccgcggacttcctcacggtcgcccccgaactagaccgcgggcaagaggccggctttaccctctcggccccgctgcgctcgctgaccaggccgtcgttggccgtcaaccagcccgggatctacccggtcctggtcaacgtcaatgggacacccgactacggtgcgcctgcgcggctcgacaatgcgcggttcctgttgcccgtggtcggagtgccacccgaccaggccaccgacttcggctccgctgttgcaccagaaacgacggcgccggtctggatcaccatgctgtggccgctggccgaccggccccggttggcccccggggcacccggtggcaccgttcccgtccggctggtcgacgacgacctggcaaactcgctggccaacggcggccggctggacatcctcctgtcggcggccgagttcgccaccaaccgggaagtcgaccccgacggcgccgtcggccgagcgctgtgcctggccatcgacccagatctactcatcaccgtcaatgcgatgaccggcggctacgtcgtgtccgactcgcccgacggggccgctcaactaccgggcaccccgacccacccgggcaccggccaggccgccgcatccagctggctggatcgattgcggacgctagtccaccggacatgcgtgacgccgctgccttttgcccaagccgacctggatgctttgcagcgggttaatgatccgaggctgagcgcgatcgcaaccatcagccccgccgacatcgtcgaccgcatcctggatgtcagctccacccgcggcgcaaccgtgctgcccgacggcccgttgaccggccgggcgatcaacttgctcagcacccacggcaacacggttgccgtcgcggccgccgattttagccccgaggaacagcagggttcgtcccagatcggctccgcgctcttacccgctaccgcgccccggcggttgtccccgcgggtggtagcggcgccgtttgatcccgcggtcggggccgcgctggccgccgcgggaacaaacccgaccgttcctacctatctagatccctcgttgttcgttcggatcgcgcatgaatcgatcaccgcgcgccgccaggacgccttgggcgcaatgctgtggcgcagcttggagccgaatgccgcgccccgtacccaaatcctggtgccgccggcgtcgtggagcctggccagcgacgacgcgcaggtcatcctgaccgcgctggccaccgccatccggtctggcctggccgtgccgcgaccactaccggcggtgatcgctgacgccgcggcccgcaccgagccaccggaacccccgggcgcttacagcgccgctcgcggccggttcaatgacgacatcaccacgcagatcggcgggcaggttgcccggctatggaagctgacctcggcgttgaccatcgatgaccgcaccgggctgaccggcgtgcagtacaccgcaccactacgcgaggacatgttgcgcgcgctgagccaatcgctaccacccgatacccgcaacgggctggcccagcagcggctggccgtcgttggaaagacgatcgacgatcttttcggcgcggtgaccatcgtcaacccgggcggctcctacactctggccaccgagcacagtccgctgccgttggcgctgcataatggcctcgccgtgccaatccgggtccggctacaggtcgatgctccgcccgggatgacggtggccgatgtcggtcagatcgagctaccgcccgggtacctgccgctacgagtaccaatcgaggtgaacttcacacagcgggttgccgtcgacgtgtcgctgcggacccccgacggcgtcgcgctgggtgaaccggtgcggttgtcggtgcactccaacgcctacggcaaggtgttgttcgcgatcacgctatccgctgcggccgtgctggtaacgctggcgggccggcgcctttggcaccggttccgtggccagcctgatcgcgccgacctggatcgccccgacctgcctaccggcaaacacgccccgcagcgccgtgccgtagccagtcgggatgacgaaaagcaccgggtatga

SEQ ID NO: 621 - protein, 815 aa, Mycobacterium tuberculosis
LSTGSAQRSRAGAVTALQLGWAALARVTSAIGVVAGLGMALTVPSAAPHALAGEPSPTPFVQVRIDQVTPDVVTTSSEPHVTVSGTVTNTGDRPVRDVMVRLEHAAAVTSSTALRTSLDGGTDQYQPAADFLTVAPELDRGQEAGFTLSAPLRSLTRPSLAVNQPGIYPVLVNVNGTPDYGAPARLDNARFLLPVVGVPPDQATDFGSAVAPETTAPVWITMLWPLADRPRLAPGAPGGTVPVRLVDDDLANSLANGGRLDILLSAAEFATNREVDPDGAVGRALCLAIDPDLLITVNAMTGGYVVSDSPDGAAQLPGTPTHPGTGQAAASSWLDRLRTLVHRTCVTPLPFAQADLDALQRVNDPRLSAIATISPADIVDRILDVSSTRGATVLPDGPLTGRAINLLSTHGNTVAVAAADFSPEEQQGSSQIGSALLPATAPRRLSPRVVAAPFDPAVGAALAAAGTNPTVPTYLDPSLFVRIAHESITARRQDALGAMLWRSLEPNAAPRTQILVPPASWSLASDDAQVILTALATAIRSGLAVPRPLPAVIADAAARTEPPEPPGAYSAARGRFNDDITTQIGGQVARLWKLTSALTIDDRTGLTGVQYTAPLREDMLRALSQSLPPDTRNGLAQQRLAVVGKTIDDLFGAVTIVNPGGSYTLATEHSPLPLALHNGLAVPIRVRLQVDAPPGMTVADVGQIELPPGYLPLRVPIEVNFTQRVAVDVSLRTPDGVALGEPVRLSVHSNAYGKVLFAITLSAAAVLVTLAGRRLWHRFRGQPDRADLDRPDLPTGKHAPQRRAVASRDDEKHRV

SEQ ID NO: 622 - DNA, 249 bp, Mycobacterium tuberculosis
  CDS (1)..(249)
atccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatc

SEQ ID NO: 623 - protein, 83 aa, Mycobacterium tuberculosis
IRALASHPNIVGVKDAKADLHSGAQIMADTGLAYYSGDDALNLPWLAMGATGFISVIAHLAAGQLRELLSAFGSGDIATARKI

SEQ ID NO: 624 - DNA, 250 bp, Mycobacterium tuberculosis
  CDS (1)..(249)
gatccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatc

SEQ ID NO: 625 - protein, 83 aa, Mycobacterium tuberculosis
DPRVGVASEHRRSQGRQSRPAQRRPNHGRHRTGLLFRRRRAQPALAGHGRHGLHQRDCPPGSRAASRVVVRLRFWGYRHRPQD

SEQ ID NO: 626 - DNA, 248 bp, Mycobacterium tuberculosis
  CDS (1)..(165)
  CDS (169)..(246)
tccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatc

SEQ ID NO: 627 - protein, 55 aa, Mycobacterium tuberculosis
SARWRRIRTSSESRTPKPTCTAAPKSWPTPDWPTIPATTRSTCPGWPWAPRASSA

SEQ ID NO: 628 - protein, 26 aa, Mycobacterium tuberculosis
LPTWQPGSFESCCPPSVLGISPPPAR

SEQ ID NO: 629 - DNA, 903 bp, Mycobacterium tuberculosis
  CDS (1)..(900)
gtgaccaccgtcggattcgacgtcgcagcgcgcctaggaaccctgctgaccgcgatggtgacaccgtttagcggcgatggctccctggacaccgccaccgcggcgcggctggccaaccacctggtcgatcaggggtgcgacggtctggtggtctcgggcaccaccggcgagtcgccgaccaccaccgacggggagaaaatcgagctgctgcgggccgtcttggaagcggtgggggaccgggcccgtgttatcgccggtgccggcacctatgacaccgcgcacagcatccggctggccaaggcttgtgcggccgagggtgcgcacgggctgctggtggtcacgccctactattccaagccgccgcagcgggggctgcaagcccatttcaccgccgtcgccgacgcgaccgagctgccgatgctgctctatgacatcccggggcggtcggcggtgccgatcgagcccgacacgatccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatcaacattgcggtcgccccgctgtgcaacgcgatgagccgcctgggtggggtgacgttgtccaaggcgggcttgcggctgcagggcatcgacgtcggtgatccccggctgccccaggtggccgcgacaccggagcagatcgacgcgttggccgccgacatgcgcgcggcctcggtgcttcggtga

SEQ ID NO: 630 - protein, 300 aa, Mycobacterium tuberculosis
VTTVGFDVAARLGTLLTAMVTPFSGDGSLDTATAARLANHLVDQGCDGLVVSGTTGESPTTTDGEKIELLRAVLEAVGDRARVIAGAGTYDTAHSIRLAKACAAEGAHGLLVVTPYYSKPPQRGLQAHFTAVADATELPMLLYDIPGRSAVPIEPDTIRALASHPNIVGVKDAKADLHSGAQIMADTGLAYYSGDDALNLPWLAMGATGFISVIAHLAAGQLRELLSAFGSGDIATARKINIAVAPLCNAMSRLGGVTLSKAGLRLQGIDVGDPRLPQVAATPEQIDALAADMRAASVLR

SEQ ID NO: 631 - DNA, 1737 bp, Mycobacterium tuberculosis
  CDS (4)..(1734)
taaggtgagcgccgtggccgagaccgcgccgctgcgcgtgcaactgatcgccaagaccgacttcttggccccacccgacgtgccctggaccaccgacgccgacggcggacccgcgctggtcgagttcgccggccgggcctgctatcagagctggtccaagcccaatcccaagaccgccaccaacgccggctacctccggcacatcatcgacgtcggacatttctcggtgctagagcatgccagcgtgtcgttctacatcaccgggatctcgcgatcgtgcacccacgagctgatccgccaccggcatttctcctactcgcagctctcccagcgctacgtacccgagaaggactcgcgggtcgtcgtgccgcccggcatggaggacgacgccgacctgcgccacatcctgaccgaggccgccgacgccgcccgcgccacctacagcgagctgctggccaagctggaagccaagttcgccgaccaacccaacgcgatcctgcgccgcaagcaggcccgccaagccgcccgcgcggtgctgcccaacgccaccgaaacccgcatcgtggtgaccggcaactaccgggcctggcggcacttcatcgcaatgcgggccagcgagcacgccgacgtggaaatccggcgactggccatcgaatgcctgcgccagctcgccgccgtggcccccgcggtgttcgccgacttcgaggtgaccaccctggccgacggcaccgaggtggcgaccagcccgttggcgaccgaagcctgaggcggcgtgtcgctggacaaacacgcgcgctcgcggccgggataaagcgccaggtaaccttgggagccgtgaccaccgtcggattcgacgtcgcagcgcgcctaggaaccctgctgaccgcgatggtgacaccgtttagcggcgatggctccctggacaccgccaccgcggcgcggctggccaaccacctggtcgatcaggggtgcgacggtctggtggtctcgggcaccaccggcgagtcgccgaccaccaccgacggggagaaaatcgagctgctgcgggccgtcttggaagcggtgggggaccgggcccgtgttatcgccggtgccggcacctatgacaccgcgcacagcatccggctggccaaggcttgtgcggccgagggtgcgcacgggctgctggtggtcacgccctactattccaagccgccgcagcgggggctgcaagcccatttcaccgccgtcgccgacgcgaccgagctgccgatgctgctctatgacatcccggggcggtcggcggtgccgatcgagcccgacacgatccgcgcgttggcgtcgcatccgaacatcgtcggagtcaaggacgccaaagccgacctgcacagcggcgcccaaatcatggccgacaccggactggcctactattccggcgacgacgcgctcaacctgccctggctggccatgggcgccacgggcttcatcagcgtgattgcccacctggcagccgggcagcttcgagagttgttgtccgccttcggttctggggatatcgccaccgcccgcaagatcaacattgcggtcgccccgctgtgcaacgcgatgagccgcctgggtggggtgacgttgtccaaggcgggcttgcggctgcagggcatcgacgtcggtgatccccggctgccccaggtggccgcgacaccggagcagatcgacgcgttggccgccgacatgcgcgcggcctcggtgcttcggtga

SEQ ID NO: 632 - protein, 577 aa, Mycobacterium tuberculosis
GERRGRDRAAARATDRQDRLLGPTRRALDHRRRRRTRAGRVRRPGLLSELVQAQSQDRHQRRLPPAHHRRRTFLGARACQRVVLHHRDLAIVHPRADPPPAFLLLAALPALRTREGLAGRRAARHGGRRRPAPHPDRGRRRRPRHLQRAAGQAGSQVRRPTQRDPAPQAGPPSRPRGAAQRHRNPHRGDRQLPGLAALHRNAGQRARRRGNPATGHRMPAPARRRGPRGVRRLRGDHPGRRHRGGDQPVGDRSLRRRVAGQTRALAAGIKRQVTLGAVTTVGFDVAARLGTLLTAMVTPFSGDGSLDTATAARLANHLVDQGCDGLVVSGTTGESPTTTDGEKIELLRAVLEAVGDRARVIAGAGTYDTAHSIRLAKACAAEGAHGLLVVTPYYSKPPQRGLQAHFTAVADATELPMLLYDIPGRSAVPIEPDTIRALASHPNIVGVKDAKADLHSGAQIMADTGLAYYSGDDALNLPWLAMGATGFISVIAHLAAGQLRELLSAFGSGDIATARKINIAVAPLCNAMSRLGGVTLSKAGLRLQGIDVGDPRLPQVAATPEQIDALAADMRAASVLR

SEQ ID NO: 633 - DNA, 495 bp, Mycobacterium tuberculosis
  CDS (1)..(495)
gcggtgaactggtgggcccggatggttcaagtacgccgtcgcaaactcgagcacaacaggagacgacggatggaaggagatgctggcgccggccagctgaaccctgccgatgcgaataagtcgtcgtctacggaggtgaaggcggcggattcggcggaatctgacgccggagccgaccagactggcccgcaggtgaaggcggcggattcggcggaatctgacgccggagagctcggcgaggacgcgtgcccagaacaggccctcgtcgagcggcgcccgtcgcggttgcggcgaggctggcttgttggcattgcggcgacgctgctcgcgttggccggtggccttggcgcagcgggttattttgcgttgcgctcacaccaggaaagccaatcaatcgcgcgcgaggaccttgcggccattgaggccgctaaggattgcgttgcggccacgcaggcacccgatgctggggcgatgtcggctagcatgcagaagatc

SEQ ID NO: 634 - protein, 165 aa, Mycobacterium tuberculosis
AVNWWARMVQVRRRKLEHNRRRRMEGDAGAGQLNPADANKSSSTEVKAADSAESDAGADQTGPQVKAADSAESDAGELGEDACPEQALVERRPSRLRRGWLVGIAATLLALAGGLGAAGYFALRSHQESQSIAREDLAAIEAAKDCVAATQAPDAGAMSASMQKI

SEQ ID NO: 635 - DNA, 497 bp, Mycobacterium tuberculosis
  CDS (1)..(6)
  CDS (10)..(99)
  CDS (103)..(138)
  CDS (142)..(195)
  CDS (199)..(495)
cagcggtgaactggtgggcccggatggttcaagtacgccgtcgcaaactcgagcacaacaggagacgacggatggaaggagatgctggcgccggccagctgaaccctgccgatgcgaataagtcgtcgtctacggaggtgaaggcggcggattcggcggaatctgacgccggagccgaccagactggcccgcaggtgaaggcggcggattcggcggaatctgacgccggagagctcggcgaggacgcgtgcccagaacaggccctcgtcgagcggcgcccgtcgcggttgcggcgaggctggcttgttggcattgcggcgacgctgctcgcgttggccggtggccttggcgcagcgggttattttgcgttgcgctcacaccaggaaagccaatcaatcgcgcgcgaggaccttgcggccattgaggccgctaaggattgcgttgcggccacgcaggcacccgatgctggggcgatgtcggctagcatgcagaagatc

SEQ ID NO: 636 - protein, 30 aa, Mycobacterium tuberculosis
TGGPGWFKYAVANSSTTGDDGWKEMLAPAS

SEQ ID NO: 637 - protein, 12 aa, Mycobacterium tuberculosis
TLPMRISRRLRR

SEQ ID NO: 638 - protein, 18 aa, Mycobacterium tuberculosis
RRRIRRNLTPEPTRLARR

SEQ ID NO: 639 - protein, 99 aa, Mycobacterium tuberculosis
RRRIRRNLTPESSARTRAQNRPSSSGARRGCGEAGLLALRRRCSRWPVALAQRVILRCAHTRKANQSRARTLRPLRPLRIALRPRRHPMLGRCRLACRR

SEQ ID NO: 640 - DNA, 496 bp, Mycobacterium tuberculosis
  CDS (1)..(117)
  CDS (121)..(162)
  CDS (166)..(219)
  CDS (223)..(420)
  CDS (424)..(429)
  CDS (433)..(480)
  CDS (484)..(495)
agcggtgaactggtgggcccggatggttcaagtacgccgtcgcaaactcgagcacaacaggagacgacggatggaaggagatgctggcgccggccagctgaaccctgccgatgcgaataagtcgtcgtctacggaggtgaaggcggcggattcggcggaatctgacgccggagccgaccagactggcccgcaggtgaaggcggcggattcggcggaatctgacgccggagagctcggcgaggacgcgtgcccagaacaggccctcgtcgagcggcgcccgtcgcggttgcggcgaggctggcttgttggcattgcggcgacgctgctcgcgttggccggtggccttggcgcagcgggttattttgcgttgcgctcacaccaggaaagccaatcaatcgcgcgcgaggaccttgcggccattgaggccgctaaggattgcgttgcggccacgcaggcacccgatgctggggcgatgtcggctagcatgcagaagatc

SEQ ID NO: 641 - protein, 39 aa, Mycobacterium tuberculosis
SGELVGPDGSSTPSQTRAQQETTDGRRCWRRPAEPCRCE

SEQ ID NO: 642 - protein, 14 aa, Mycobacterium tuberculosis
VVVYGGEGGGFGGI

SEQ ID NO: 643 - protein, 18 aa, Mycobacterium tuberculosis
RRSRPDWPAGEGGGFGGI

SEQ ID NO: 644 - protein, 66 aa, Mycobacterium tuberculosis
RRRARRGRVPRTGPRRAAPVAVAARLACWHCGDAARVGRWPWRSGLFCVALTPGKPINRARGPCGH

SEQ ID NO: 645 - protein, 16 aa, Mycobacterium tuberculosis
GLRCGHAGTRCWGDVG

SEQ ID NO: 646 - protein, 4 aa, Mycobacterium tuberculosis
HAED

SEQ ID NO: 647 - DNA, 642 bp, Mycobacterium tuberculosis
  CDS (1)..(639)
gtgaaggcggcggattcggcggaatctgacgccggagccgaccagactggcccgcaggtgaaggcggcggattcggcggaatctgacgccggagagctcggcgaggacgcgtgcccagaacaggccctcgtcgagcggcgcccgtcgcggttgcggcgaggctggcttgttggcattgcggcgacgctgctcgcgttggccggtggccttggcgcagcgggttattttgcgttgcgctcacaccaggaaagccaatcaatcgcgcgcgaggaccttgcggccattgaggccgctaaggattgcgttgcggccacgcaggcacccgatgctggggcgatgtcggctagcatgcagaagatcatcgagtgtggcaccggtgatttcggtgcccaggcgtcgttgtacaccagcatgctcgtcgaggcgtatcaagcggccagcgtccacgtgcaagtgaccgatatgcgcgcggcggtcgagcgcaacaacaatgacgggtcggtcgatgttctggtggcgctccgggtcaaggtgtccaacaccgactcggatgcccatgaagtcggctaccgtcttcgggtccggatggcactggatgagggccgctataagatcgccaaactcgaccaggtgacgaagtga

SEQ ID NO: 648 - protein, 213 aa, Mycobacterium tuberculosis
VKAADSAESDAGADQTGPQVKAADSAESDAGELGEDACPEQALVERRPSRLRRGWLVGIAATLLALAGGLGAAGYFALRSHQESQSIAREDLAAIEAAKDCVAATQAPDAGAMSASMQKIIECGTGDFGAQASLYTSMLVEAYQAASVHVQVTDMRAAVERNNNDGSVDVLVALRVKVSNTDSDAHEVGYRLRVRMALDEGRYKIAKLDQVTK

SEQ ID NO: 649 - DNA, 774 bp, Mycobacterium tuberculosis
  CDS (4)..(771)
tgaactggtggggccggatggtgtcaagtacgccgtcgcaaactcgagcacaacaggagacgacggatggaaggagatgctggcgccggccagctgaaccctgccgatgcgaataagtcgtcgtctacggaggtgaaggcggcggattcggcggaatctgacgccggagccgaccagactggcccgcaggtgaaggcggcggattcggcggaatctgacgccggagagctcggcgaggacgcgtgcccagaacaggccctcgtcgagcggcgcccgtcgcggttgcggcgaggctggcttgttggcattgcggcgacgctgctcgcgttggccggtggccttggcgcagcgggttattttgcgttgcgctcacaccaggaaagccaatcaatcgcgcgcgaggaccttgcggccattgaggccgctaaggattgcgttgcggccacgcaggcacccgatgctggggcgatgtcggctagcatgcagaagatcatcgagtgtggcaccggtgatttcggtgcccaggcgtcgttgtacaccagcatgctcgtcgaggcgtatcaagcggccagcgtccacgtgcaagtgaccgatatgcgcgcggcggtcgagcgcaacaacaatgacgggtcggtcgatgttctggtggcgctccgggtcaaggtgtccaacaccgactcggatgcccatgaagtcggctaccgtcttcgggtccggatggcactggatgagggccgctataagatcgccaaactcgaccaggtgacgaagtga

SEQ ID NO: 650 - protein, 256 aa, Mycobacterium tuberculosis
TGGAGWCQVRRRKLEHNRRRRMEGDAGAGQLNPADANKSSSTEVKAADSAESDAGADQTGPQVKAADSAESDAGELGEDACPEQALVERRPSRLRRGWLVGIAATLLALAGGLGAAGYFALRSHQESQSIAREDLAAIEAAKDCVAATQAPDAGAMSASMQKIIECGTGDFGAQASLYTSMLVEAYQAASVHVQVTDMRAAVERNNNDGSVDVLVALRVKVSNTDSDAHEVGYRLRVRMALDEGRYKIAKLDQVTK

SEQ ID NO: 651 - DNA, 165 bp, Mycobacterium tuberculosis
  CDS (1)..(165)
acacctccccccccgccgccgctgccgccggttccctttcccaaggaatgtccggcgccgggcgtgatgcaaggctgccttgagagcaccagcggcttgatcatgggcatcgacagcaagaccgcactggtcgccgagcgcatcaccggtgccgtcgaggagatc

SEQ ID NO: 652 - protein, 55 aa, Mycobacterium tuberculosis
TPPPPPPLPPVPFPKECPAPGVMQGCLESTSGLIMGIDSKTALVAERITGAVEEI

SEQ ID NO: 653 - DNA, 164 bp, Mycobacterium tuberculosis
  CDS (1)..(63)
  CDS (67)..(96)
  CDS (100)..(162)
cacctccccccccgccgccgctgccgccggttccctttcccaaggaatgtccggcgccgggcgtgatgcaaggctgccttgagagcaccagcggcttgatcatgggcatcgacagcaagaccgcactggtcgccgagcgcatcaccggtgccgtcgaggagatc

SEQ ID NO: 654 - protein, 21 aa, Mycobacterium tuberculosis
HLPPRRRCRRFPFPRNVRRRA

SEQ ID NO: 655 - protein, 10 aa, Mycobacterium tuberculosis
CKAALRAPAA

SEQ ID NO: 656 - protein, 21 aa, Mycobacterium tuberculosis
SWASTARPHWSPSASPVPSRR

SEQ ID NO: 657 - DNA, 166 bp, Mycobacterium tuberculosis
  CDS (1)..(81)
  CDS (85)..(165)
gacacctccccccccgccgccgctgccgccggttccctttcccaaggaatgtccggcgccgggcgtgatgcaaggctgccttgagagcaccagcggcttgatcatgggcatcgacagcaagaccgcactggtcgccgagcgcatcaccggtgccgtcgaggagatc

SEQ ID NO: 658 - protein, 27 aa, Mycobacterium tuberculosis
DTSPPAAAAAGSLSQGMSGAGRDARLP

SEQ ID NO: 659 - protein, 27 aa, Mycobacterium tuberculosis
EHQRLDHGHRQQDRTGRRAHHRCRRGD

SEQ ID NO: 660 - DNA, 1122 bp, Mycobacterium tuberculosis
  CDS (1)..(1119)
atgtggacaacgcggttggttcgatccggactcgccgcgctgtgcgcggcagtgctggtatcgagcggctgcgcacggttcaacgacgctcaatctcagccgttcaccaccgaaccggagctgcggccccaacccagctcgacacctccccccccgccgccgctgccgccggttccctttcccaaggaatgtccggcgccgggcgtgatgcaaggctgccttgagagcaccagcggcttgatcatgggcatcgacagcaagaccgcactggtcgccgagcgcatcaccggtgccgtcgaggagatctctatcagcgccgagccgaaggtaaagacggtcatccccgtggatcctgccggtgacggtggcttgatggacattgtgctgtcgcccacctactcgcaagaccggctgatgtacgcctacatcagcacgcccaccgacaaccgggtggtgcgagtggccgacggcgacatccccaaggacatcctgaccggcatccccaaaggtgctgccggtaacaccggggcgctgatcttcaccagtcccaccacgctggtcgtgatgaccggggatgctggcgacccggcgttggccgccgatccccaatcgttggccggtaaggtcctgcgtatcgaacagcccaccaccatcggccagacgccgccgacgacggcgctgtctggcatcggctccggcggcggcttgtgcatcgatccggtcgacggctcgctatatgtcgccgaccgcacgccaacggcggaccgattgcagcgcatcaccaagaactcggaggtctctacggtatggacctggccggacaagcccggcgtggccgggtgtgccgcgatggacggcaccgtgctggtcaacctgattaataccaaactgacggtggcggtccggctcgcgccgtcgaccggtgcggtcaccggagaacccgacgttgtccgcaaagacactcatgcgcatgcgtgggcattacggatgtcgccggacggcaacgtctggggagccaccgtcaacaagaccgccggcgacgccgagaagctcgacgatgtggtgttcccgctgttcccgcagggtggcggcttcccgcgcaacaacgacgacaagacctga

SEQ ID NO: 661 - protein, 373 aa, Mycobacterium tuberculosis
MWTTRLVRSGLAALCAAVLVSSGCARFNDAQSQPFTTEPELRPQPSSTPPPPPPLPPVPFPKECPAPGVMQGCLESTSGLIMGIDSKTALVAERITGAVEEISISAEPKVKTVIPVDPAGDGGLMDIVLSPTYSQDRLMYAYISTPTDNRVVRVADGDIPKDILTGIPKGAAGNTGALIFTSPTTLVVMTGDAGDPALAADPQSLAGKVLRIEQPTTIGQTPPTTALSGIGSGGGLCIDPVDGSLYVADRTPTADRLQRITKNSEVSTVWTWPDKPGVAGCAAMDGTVLVNLINTKLTVAVRLAPSTGAVTGEPDVVRKDTHAHAWALRMSPDGNVWGATVNKTAGDAEKLDDVVFPLFPQGGGFPRNNDDKT

SEQ ID NO: 662 - DNA, 1287 bp, Mycobacterium tuberculosis
  CDS (4)..(1284)
taaggccatttagtgccgaattggggatttgagcggcgctttcgccagacaatccgcacattgaccctgaccagcccaccaaaaggccccaattgggccgccatgccgacagtgcgcaccccggcaggtggcggcgatgcccacaatgtccgtagcctgtcggtcatgtggacaacgcggttggttcgatccggactcgccgcgctgtgcgcggcagtgctggtatcgagcggctgcgcacggttcaacgacgctcaatctcagccgttcaccaccgaaccggagctgcggccccaacccagctcgacacctccccccccgccgccgctgccgccggttccctttcccaaggaatgtccggcgccgggcgtgatgcaaggctgccttgagagcaccagcggcttgatcatgggcatcgacagcaagaccgcactggtcgccgagcgcatcaccggtgccgtcgaggagatctctatcagcgccgagccgaaggtaaagacggtcatccccgtggatcctgccggtgacggtggcttgatggacattgtgctgtcgcccacctactcgcaagaccggctgatgtacgcctacatcagcacgcccaccgacaaccgggtggtgcgagtggccgacggcgacatccccaaggacatcctgaccggcatccccaaaggtgctgccggtaacaccggggcgctgatcttcaccagtcccaccacgctggtcgtgatgaccggggatgctggcgacccggcgttggccgccgatccccaatcgttggccggtaaggtcctgcgtatcgaacagcccaccaccatcggccagacgccgccgacgacggcgctgtctggcatcggctccggcggcggcttgtgcatcgatccggtcgacggctcgctatatgtcgccgaccgcacgccaacggcggaccgattgcagcgcatcaccaagaactcggaggtctctacggtatggacctggccggacaagcccggcgtggccgggtgtgccgcgatggacggcaccgtgctggtcaacctgattaataccaaactgacggtggcggtccggctcgcgccgtcgaccggtgcggtcaccggagaacccgacgttgtccgcaaagacactcatgcgcatgcgtgggcattacggatgtcgccggacggcaacgtctggggagccaccgtcaacaagaccgccggcgacgccgagaagctcgacgatgtggtgttcccgctgttcccgcagggtggcggcttcccgcgcaacaacgacgacaagacctga

SEQ ID NO: 663 - protein, 427 aa, Mycobacterium tuberculosis
GHLVPNWGFERRFRQTIRTLTLTSPPKGPNWAAMPTVRTPAGGGDAHNVRSLSVMWTTRLVRSGLAALCAAVLVSSGCARFNDAQSQPFTTEPELRPQPSSTPPPPPPLPPVPFPKECPAPGVMQGCLESTSGLIMGIDSKTALVAERITGAVEEISISAEPKVKTVIPVDPAGDGGLMDIVLSPTYSQDRLMYAYISTPTDNRVVRVADGDIPKDILTGIPKGAAGNTGALIFTSPTTLVVMTGDAGDPALAADPQSLAGKVLRIEQPTTIGQTPPTTALSGIGSGGGLCIDPVDGSLYVADRTPTADRLQRITKNSEVSTVWTWPDKPGVAGCAAMDGTVLVNLINTKLTVAVRLAPSTGAVTGEPDVVRKDTHAHAWALRMSPDGNVWGATVNKTAGDAEKLDDVVFPLFPQGGGFPRNNDDKT

SEQ ID NO: 664 - DNA, 334 bp, Mycobacterium tuberculosis
  CDS (1)..(186)
  CDS (190)..(333)
gaaggccttgttgagccggcgcacgaaaacgatcgttgtgtgtacattggtgtgtatggctcggttgaacgtgtatgtgcccgacgaattggcggagcgcgccagggcgcggggcttgaacgtctcggcgctgactcaggccgcgatcagtgccgagttggagaactccgcaaccgatgcgtggcttgaggggttggaacccagaagcaccggcgctcggcatgatgacgtgctgggtgcgatcgatgccgctcgcgatgagttcgaagcgtgagagcatcgcccacttcgccgccggagcaggtggtcgtcgacgcgagtgccatggtggatc

SEQ ID NO: 665 - protein, 62 aa, Mycobacterium tuberculosis
EGLVEPAHENDRCVYIGVYGSVERVCARRIGGARQGAGLERLGADSGRDQCRVGELRNRCVA

SEQ ID NO: 666 - DNA, 333 bp, Mycobacterium tuberculosis
  CDS (1)..(270)
  CDS (274)..(333)
aaggccttgttgagccggcgcacgaaaacgatcgttgtgtgtacattggtgtgtatggctcggttgaacgtgtatgtgcccgacgaattggcggagcgcgccagggcgcggggcttgaacgtctcggcgctgactcaggccgcgatcagtgccgagttggagaactccgcaaccgatgcgtggcttgaggggttggaacccagaagcaccggcgctcggcatgatgacgtgctgggtgcgatcgatgccgctcgcgatgagttcgaagcgtgagagcatcgcccacttcgccgccggagcaggtggtcgtcgacgcgagtgccatggtggatc

SEQ ID NO: 667 - protein, 90 aa, Mycobacterium tuberculosis
KALLSRRTKTIVVCTLVCMARLNVYVPDELAERARARGLNVSALTQAAISAELENSATDAWLEGLEPRSTGARHDDVLGAIDAARDEFEA

SEQ ID NO: 668 - protein, 20 aa, Mycobacterium tuberculosis
EHRPLRRRSRWSSTRVPWWI

SEQ ID NO: 669 - DNA, 332 bp, Mycobacterium tuberculosis
  CDS (1)..(9)
  CDS (13)..(63)
  CDS (67)..(114)
  CDS (118)..(129)
  CDS (133)..(331)
aggccttgttgagccggcgcacgaaaacgatcgttgtgtgtacattggtgtgtatggctcggttgaacgtgtatgtgcccgacgaattggcggagcgcgccagggcgcggggcttgaacgtctcggcgctgactcaggccgcgatcagtgccgagttggagaactccgcaaccgatgcgtggcttgaggggttggaacccagaagcaccggcgctcggcatgatgacgtgctgggtgcgatcgatgccgctcgcgatgagttcgaagcgtgagagcatcgcccacttcgccgccggagcaggtggtcgtcgacgcgagtgccatggtggatc

SEQ ID NO: 670 - protein, 17 aa, Mycobacterium tuberculosis
AGARKRSLCVHWCVWLG

SEQ ID NO: 671 - protein, 16 aa, Mycobacterium tuberculosis
TCMCPTNWRSAPGRGA

SEQ ID NO: 672 - protein, 4 aa, Mycobacterium tuberculosis
TSRR

SEQ ID NO: 673 - protein, 66 aa, Mycobacterium tuberculosis
LRPRSVPSWRTPQPMRGLRGWNPEAPALGMMTCWVRSMPLAMSSKRESIAHFAAGAGGRRRECHGG

SEQ ID NO: 674 - DNA, 414 bp, Mycobacterium tuberculosis
  CDS (1)..(411)
gtgagagcatcgcccacttcgccgccggagcaggtggtcgtcgacgcgagtgccatggtggatctactggctcgcactagcgatcggtgctctgcggtgcgcgcgcggctggctcggaccgcgatgcacgcgccggcgcacttcgatgcagaggtgttgtcggcgctggggcgcatgcagcgcgccggcgcactcaccgttgcctatgtcgatgcggcactggaggagttgcgacaggtgccggtgactcgacacggtctttcgtcgctgcttgctggagcgtggtcgcgccgcgacaccctccgcctgaccgatgccctctacgtcgagctggccgaaacggcaggtctggtgttgttgaccaccgacgaaagattggcacgcgcctggccctcggctcacgccatcggctga

SEQ ID NO: 675 - protein, 137 aa, Mycobacterium tuberculosis
VRASPTSPPEQVVVDASAMVDLLARTSDRCSAVRARLARTAMHAPAHFDAEVLSALGRMQRAGALTVAYVDAALEELRQVPVTRHGLSSLLAGAWSRRDTLRLTDALYVELAETAGLVLLTTDERLARAWPSAHAIG

SEQ ID NO: 676 - DNA, 426 bp, Mycobacterium tuberculosis
  CDS (4)..(423)
tgagttcgaagcgtgagagcatcgcccacttcgccgccggagcaggtggtcgtcgacgcgagtgccatggtggatctactggctcgcactagcgatcggtgctctgcggtgcgcgcgcggctggctcggaccgcgatgcacgcgccggcgcacttcgatgcagaggtgttgtcggcgctggggcgcatgcagcgcgccggcgcactcaccgttgcctatgtcgatgcggcactggaggagttgcgacaggtgccggtgactcgacacggtctttcgtcgctgcttgctggagcgtggtcgcgccgcgacaccctccgcctgaccgatgccctctacgtcgagctggccgaaacggcaggtctggtgttgttgaccaccgacgaaagattggcacgcgcctggccctcggctcacgccatcggctga

SEQ ID NO: 677 - protein, 140 aa, Mycobacterium tuberculosis
VRSVRASPTSPPEQVVVDASAMVDLLARTSDRCSAVRARLARTAMHAPAHFDAEVLSALGRMQRAGALTVAYVDAALEELRQVPVTRHGLSSLLAGAWSRRDTLRLTDALYVELAETAGLVLLTTDERLARAWPSAHAIG

SEQ ID NO: 678 - DNA, 277 bp, Mycobacterium tuberculosis
  CDS (1)..(21)
  CDS (25)..(42)
  CDS (46)..(150)
  CDS (154)..(276)
cctggccgggacgcctacgtgtagcccgcggctagcacaggatagccattgttgtgcggtagcgccaaaacgatcagcccttcgcggacatgtcagcacccgccttggccgggagagcggcgtcgtgaccgtgctgtcaccacgtctggttaggctcggggcgcgggctggcgcggaggaggtgtgttgcggaggaggtgtgttgtagtggggacggcggatcggccgttggacgcctcggccttgcgggactgggcacacgccgtcgtcagcgatc

SEQ ID NO: 679 - protein, 7 aa, Mycobacterium tuberculosis
PGRDAYV

SEQ ID NO: 680 - protein, 6 aa, Mycobacterium tuberculosis
PAASTG

SEQ ID NO: 681 - protein, 35 aa, Mycobacterium tuberculosis
PLLCGSAKTISPSRTCQHPPWPGERRRDRAVTTSG

SEQ ID NO: 682 - protein, 41 aa, Mycobacterium tuberculosis
ARGAGWRGGGVLRRRCVVVGTADRPLDASALRDWAHAVVSD

SEQ ID NO: 683 - DNA, 276 bp, Mycobacterium tuberculosis
  CDS (1)..(204)
  CDS (208)..(276)
ctggccgggacgcctacgtgtagcccgcggctagcacaggatagccattgttgtgcggtagcgccaaaacgatcagcccttcgcggacatgtcagcacccgccttggccgggagagcggcgtcgtgaccgtgctgtcaccacgtctggttaggctcggggcgcgggctggcgcggaggaggtgtgttgcggaggaggtgtgttgtagtggggacggcggatcggccgttggacgcctcggccttgcgggactgggcacacgccgtcgtcagcgatc

SEQ ID NO: 684 - protein, 68 aa, Mycobacterium tuberculosis
LAGTPTCSPRLAQDSHCCAVAPKRSALRGHVSTRLGRESGVVTVLSPRLVRLGARAGAEEVCCGGGVL

SEQ ID NO: 685 - protein, 23 aa, Mycobacterium tuberculosis
WGRRIGRWTPRPCGTGHTPSSAI

SEQ ID NO: 686 - DNA, 275 bp, Mycobacterium tuberculosis
  CDS (1)..(30)
  CDS (34)..(57)
  CDS (61)..(123)
  CDS (127)..(273)
tggccgggacgcctacgtgtagcccgcggctagcacaggatagccattgttgtgcggtagcgccaaaacgatcagcccttcgcggacatgtcagcacccgccttggccgggagagcggcgtcgtgaccgtgctgtcaccacgtctggttaggctcggggcgcgggctggcgcggaggaggtgtgttgcggaggaggtgtgttgtagtggggacggcggatcggccgttggacgcctcggccttgcgggactgggcacacgccgtcgtcagcgatc

SEQ ID NO: 687 - protein, 10 aa, Mycobacterium tuberculosis
WPGRLRVARG

SEQ ID NO: 688 - protein, 8 aa, Mycobacterium tuberculosis
HRIAIVVR

SEQ ID NO: 689 - protein, 21 aa, Mycobacterium tuberculosis
RQNDQPFADMSAPALAGRAAS

SEQ ID NO: 690 - protein, 49 aa, Mycobacterium tuberculosis
PCCHHVWLGSGRGLARRRCVAEEVCCSGDGGSAVGRLGLAGLGTRRRQR

SEQ ID NO: 691 - DNA, 255 bp, Mycobacterium tuberculosis
  CDS (1)..(252)
gtggggacggcggatcggccgttggacgcctcggccttgcgggactgggcacacgccgtcgtcagcgatctgatcctccacatcgacgagatcaaccggctcaatgtgttcccggtcgctgactccgataccggcgtcaacatgctgttcaccatgcgtgccgcggtcgtagaagctgatttgcacgcgaattcgcaggctgacgccgaagacgtggcgcgggttgcggccgctctcgcggccggcgcgcgttga

SEQ ID NO: 692 - protein, 84 aa, Mycobacterium tuberculosis
VGTADRPLDASALRDWAHAVVSDLILHIDEINRLNVFPVADSDTGVNMLFTMRAAVVEADLHANSQADAEDVARVAAALAAGAR

SEQ ID NO: 693 - DNA, 312 bp, Mycobacterium tuberculosis
  CDS (4)..(309)
taggctcggggcgcgggctggcgcggaggaggtgtgttgcggaggaggtgtgttgtagtggggacggcggatcggccgttggacgcctcggccttgcgggactgggcacacgccgtcgtcagcgatctgatcctccacatcgacgagatcaaccggctcaatgtgttcccggtcgctgactccgataccggcgtcaacatgctgttcaccatgcgtgccgcggtcgtagaagctgatttgcacgcgaattcgcaggctgacgccgaagacgtggcgcgggttgcggccgctctcgcggccggcgcgcgttga

SEQ ID NO: 694 - protein, 102 aa, Mycobacterium tuberculosis
ARGAGWRGGGVLRRRCVVVGTADRPLDASALRDWAHAVVSDLILHIDEINRLNVFPVADSDTGVNMLFTMRAAVVEADLHANSQADAEDVARVAAALAAGAR

SEQ ID NO: 695 - DNA, 1413 bp, Mycobacterium tuberculosis
  CDS (1)..(1410)
ttgaacggagctcgcggcaactccggcgtgatcctgtcccagatcctgcgcgggatcgcagaggtgaccgcgactgcggccgccgcctctggcgcggtattgcgggcggtcgacgccaacgccctcggggccgcgttgtggcgcggcgtcgagttggtcgtcgcgtcgatgggtggcgtggaggtgccgggaactatcgtctcggtgctgcgggccgccgccggagccgtcgaccagtgcgcgcacgaggggttggccggtgcggtcaccgccgccggtgacgcggcggtcatcgcgctggaaaagacccccgaacagcttgacgtgctcgccgatgcgggcgcggtggacgccggcggacggggcctgctggttctgctggacgcgttgcgctccaccatctgcgggcaggcacctgcccgggcggtctacgaaccctcgccgcgcgcgttgccgaccgacacggctacccaacgccccgccccgcaattcgaggtgatgtatctgttggcggtatgtgatgctgcagcggcggaccagttgcgggatcgactcaaggaattgggtgagtcggtggccatcgccgctgctccgcccgacagctactccgtacacgtccacaccgacgacgccggtgccgccgtggaagccggattggcggtggggcgagttagccggatcgtgatctcggcgctcggttccgggaccagcggattgccggccggtggctggacgcggggccgcgccgtgctggcggtcgtcgacggcgacggtgccgccgagctgttcgccggggagggcgcctgcgtgctgcgaccgggtccagacgccgtgacaccggccgccgatatcagtgcccaccagctggtgcgggccgtggtagacaccggcgccgcgcacgtgatggtgctgcccaatggctatgtggccgccgaagaactggtggccgggtgtaccgcggcgatcggctggggcgtcgacgtggtacccgtgccgaccggatcgatggtgcaggggttggccgcgctggccgtgcatgacgcggcccgccaggccgtcgacgacggctacagcatggcccgtgccgccggtgcttcccggcacggatcggtgcgcattgccacccaaaaggcgctgacctgggccggtacctgcaagccgggcgacggtctgggtatcgcgggcgacgaggtgctgatcgtcgccgacgatgtcgccgcggcggccatcggtctggtcgacctgttgttggcatcgggaggcgatctggtgacggtgctaattggcgccggcgtaaccgaagacgtggctgtcgtcctggaacggcatgtgcacgaccaccatccaggcaccgagctggtctcctaccgcaccggacaccgcggcgacgcgctgctgatcggggtcgagtag

SEQ ID NO: 696 - protein, 470 aa, Mycobacterium tuberculosis
LNGARGNSGVILSQILRGIAEVTATAAAASGAVLRAVDANALGAALWRGVELVVASMGGVEVPGTIVSVLRAAAGAVDQCAHEGLAGAVTAAGDAAVIALEKTPEQLDVLADAGAVDAGGRGLLVLLDALRSTICGQAPARAVYEPSPRALPTDTATQRPAPQFEVMYLLAVCDAAAADQLRDRLKELGESVAIAAAPPDSYSVHVHTDDAGAAVEAGLAVGRVSRIVISALGSGTSGLPAGGWTRGRAVLAVVDGDGAAELFAGEGACVLRPGPDAVTPAADISAHQLVRAVVDTGAAHVMVLPNGYVAAEELVAGCTAAIGWGVDVVPVPTGSMVQGLAALAVHDAARQAVDDGYSMARAAGASRHGSVRIATQKALTWAGTCKPGDGLGIAGDEVLIVADDVAAAAIGLVDLLLASGGDLVTVLIGAGVTEDVAVVLERHVHDHHPGTELVSYRTGHRGDALLIGVE

SEQ ID NO: 697 - DNA, 1722 bp, Mycobacterium tuberculosis
  CDS (1)..(177)
  CDS (181)..(234)
  CDS (238)..(258)
  CDS (262)..(1719)
ttaggctcggggcgcgggctggcgcggaggaggtgtgttgcggaggaggtgtgttgtagtggggacggcggatcggccgttggacgcctcggccttgcgggactgggcacacgccgtcgtcagcgatctgatcctccacatcgacgagatcaaccggctcaatgtgttcccggtcgctgactccgataccggcgtcaacatgctgttcaccatgcgtgccgcggtcgtagaagctgatttgcacgcgaattcgcaggctgacgccgaagacgtggcgcgggttgcggccgctctcgcggccggcgcgcgttgaacggagctcgcggcaactccggcgtgatcctgtcccagatcctgcgcgggatcgcagaggtgaccgcgactgcggccgccgcctctggcgcggtattgcgggcggtcgacgccaacgccctcggggccgcgttgtggcgcggcgtcgagttggtcgtcgcgtcgatgggtggcgtggaggtgccgggaactatcgtctcggtgctgcgggccgccgccggagccgtcgaccagtgcgcgcacgaggggttggccggtgcggtcaccgccgccggtgacgcggcggtcatcgcgctggaaaagacccccgaacagcttgacgtgctcgccgatgcgggcgcggtggacgccggcggacggggcctgctggttctgctggacgcgttgcgctccaccatctgcgggcaggcacctgcccgggcggtctacgaaccctcgccgcgcgcgttgccgaccgacacggctacccaacgccccgccccgcaattcgaggtgatgtatctgttggcggtatgtgatgctgcagcggcggaccagttgcgggatcgactcaaggaattgggtgagtcggtggccatcgccgctgctccgcccgacagctactccgtacacgtccacaccgacgacgccggtgccgccgtggaagccggattggcggtggggcgagttagccggatcgtgatctcggcgctcggttccgggaccagcggattgccggccggtggctggacgcggggccgcgccgtgctggcggtcgtcgacggcgacggtgccgccgagctgttcgccggggagggcgcctgcgtgctgcgaccgggtccagacgccgtgacaccggccgccgatatcagtgcccaccagctggtgcgggccgtggtagacaccggcgccgcgcacgtgatggtgctgcccaatggctatgtggccgccgaagaactggtggccgggtgtaccgcggcgatcggctggggcgtcgacgtggtacccgtgccgaccggatcgatggtgcaggggttggccgcgctggccgtgcatgacgcggcccgccaggccgtcgacgacggctacagcatggcccgtgccgccggtgcttcccggcacggatcggtgcgcattgccacccaaaaggcgctgacctgggccggtacctgcaagccgggcgacggtctgggtatcgcgggcgacgaggtgctgatcgtcgccgacgatgtcgccgcggcggccatcggtctggtcgacctgttgttggcatcgggaggcgatctggtgacggtgctaattggcgccggcgtaaccgaagacgtggctgtcgtcctggaacggcatgtgcacgaccaccatccaggcaccgagctggtctcctaccgcaccggacaccgcggcgacgcgctgctgatcggggtcgagtag

SEQ ID NO: 698 - protein, 59 aa, Mycobacterium tuberculosis
LGSGRGLARRRCVAEEVCCSGDGGSAVGRLGLAGLGTRRRQRSDPPHRRDQPAQCVPGR

SEQ ID NO: 699 - protein, 18 aa, Mycobacterium tuberculosis
LRYRRQHAVHHACRGRRS

SEQ ID NO: 700 - protein, 7 aa, Mycobacterium tuberculosis
FAREFAG

SEQ ID NO: 701 - protein, 486 aa, Mycobacterium tuberculosis
RRRRGAGCGRSRGRRALNGARGNSGVILSQILRGIAEVTATAAAASGAVLRAVDANALGAALWRGVELVVASMGGVEVPGTIVSVLRAAAGAVDQCAHEGLAGAVTAAGDAAVIALEKTPEQLDVLADAGAVDAGGRGLLVLLDALRSTICGQAPARAVYEPSPRALPTDTATQRPAPQFEVMYLLAVCDAAAADQLRDRLKELGESVAIAAAPPDSYSVHVHTDDAGAAVEAGLAVGRVSRIVISALGSGTSGLPAGGWTRGRAVLAVVDGDGAAELFAGEGACVLRPGPDAVTPAADISAHQLVRAVVDTGAAHVMVLPNGYVAAEELVAGCTAAIGWGVDVVPVPTGSMVQGLAALAVHDAARQAVDDGYSMARAAGASRHGSVRIATQKALTWAGTCKPGDGLGIAGDEVLIVADDVAAAAIGLVDLLLASGGDLVTVLIGAGVTEDVAVVLERHVHDHHPGTELVSYRTGHRGDALLIGVE

SEQ ID NO: 702 - DNA, 1722 bp, Mycobacterium tuberculosis; identical to SEQ ID NO: 697
  CDS (5)..(310)
  CDS (314)..(337)
  CDS (341)..(373)
  CDS (377)..(805)
  CDS (809)..(991)
  CDS (995)..(1141)
  CDS (1145)..(1189)
  CDS (1193)..(1210)
  CDS (1214)..(1444)
  CDS (1448)..(1504)
  CDS (1508)..(1579)
  CDS (1583)..(1588)
  CDS (1592)..(1603)
  CDS (1607)..(1720)

SEQ ID NO: 703 - protein, 102 aa, Mycobacterium tuberculosis; identical to SEQ ID NO: 694

SEQ ID NO: 704 - protein, 8 aa, Mycobacterium tuberculosis
TELAATPA

SEQ ID NO: 705 - protein, 11 aa, Mycobacterium tuberculosis
SCPRSCAGSQR

SEQ ID NO: 706 - protein, 143 aa, Mycobacterium tuberculosis
PRLRPPPLARYCGRSTPTPSGPRCGAASSWSSRRWVAWRCRELSSRCCGPPPEPSTSARTRGWPVRSPPPVTRRSSRWKRPPNSLTCSPMRARWTPADGACWFCWTRCAPPSAGRHLPGRSTNPRRARCRPTRLPNAPPRNSR

SEQ ID NO: 707 - protein, 61 aa, Mycobacterium tuberculosis
CICWRYVMLQRRTSCGIDSRNWVSRWPSPLLRPTATPYTSTPTTPVPPWKPDWRWGELAGS

SEQ ID NO: 708 - protein, 49 aa, Mycobacterium tuberculosis
SRRSVPGPADCRPVAGRGAAPCWRSSTATVPPSCSPGRAPACCDRVQTP

SEQ ID NO: 709 - protein, 15 aa, Mycobacterium tuberculosis
HRPPISVPTSWCGPW

SEQ ID NO: 710 - protein, 6 aa, Mycobacterium tuberculosis
TPAPRT

SEQ ID NO: 711 - protein, 77 aa, Mycobacterium tuberculosis
WCCPMAMWPPKNWWPGVPRRSAGASTWYPCRPDRWCRGWPRWPCMTRPARPSTTATAWPVPPVLPGTDRCALPPKRR

SEQ ID NO: 712 - protein, 19 aa, Mycobacterium tuberculosis
PGPVPASRATVWVSRATRC

SEQ ID NO: 713 - protein, 24 aa, Mycobacterium tuberculosis
SSPTMSPRRPSVWSTCCWHREAIW

SEQ ID NO: 714 - protein, 4 aa, Mycobacterium tuberculosis
LAPA

SEQ ID NO: 715 - protein, 33 aa, Mycobacterium tuberculosis
PKTWLSSWNGMCTTTIQAPSWSPTAPDTAATRC

SEQ ID NO: 716 - protein, 4 aa, Mycobacterium tuberculosis
SGSS

SEQ ID NO: 717 - DNA, 1722 bp, Mycobacterium tuberculosis; identical to SEQ ID NO: 697
  CDS (3)..(56)
  CDS (60)..(128)
  CDS (132)..(227)
  CDS (231)..(587)
  CDS (591)..(629)
  CDS (633)..(827)
  CDS (831)..(875)
  CDS (879)..(980)
  CDS (984)..(1346)
  CDS (1350)..(1721)

SEQ ID NO: 718 - protein, 18 aa, Mycobacterium tuberculosis
RLGARAGAEEVCCGGGVL

SEQ ID NO: 719 - protein, 23 aa, Mycobacterium tuberculosis
WGRRIGRWTPRPCGTGHTPSSAI

SEQ ID NO: 720 - protein, 32 aa, Mycobacterium tuberculosis
SSTSTRSTGSMCSRSLTPIPASTCCSPCVPRS

SEQ ID NO: 721 - protein, 119 aa, Mycobacterium tuberculosis
KLICTRIRRLTPKTWRGLRPLSRPARVERSSRQLRRDPVPDPARDRRGDRDCGRRLWRGIAGGRRQRPRGRVVARRRVGRRVDGWRGGAGNYRLGAAGRRRSRRPVRARGVGRCGHRRR

SEQ ID NO: 722 - protein, 13 aa, Mycobacterium tuberculosis
RGGHRAGKDPRTA

SEQ ID NO: 723 - protein, 65 aa, Mycobacterium tuberculosis
RARRCGRGGRRRTGPAGSAGRVALHHLRAGTCPGGLRTLAARVADRHGYPTPRPAIRGDVSVGGM

SEQ ID NO: 724 - protein, 15 aa, Mycobacterium tuberculosis
CCSGGPVAGSTQGIG

SEQ ID NO: 725 - protein, 34 aa, Mycobacterium tuberculosis
VGGHRRCSARQLLRTRPHRRRRCRRGSRIGGGAS

SEQ ID NO: 726 - protein, 121 aa, Mycobacterium tuberculosis
PDRDLGARFRDQRIAGRWLDAGPRRAGGRRRRRCRRAVRRGGRLRAATGSRRRDTGRRYQCPPAGAGRGRHRRRARDGAAQWLCGRRRTGGRVYRGDRLGRRRGTRADRIDGAGVGRAGRA

SEQ ID NO: 727 - protein, 124 aa, Mycobacterium tuberculosis
RGPPGRRRRLQHGPCRRCFPARIGAHCHPKGADLGRYLQAGRRSGYRGRRGADRRRRCRRGGHRSGRPVVGIGRRSGDGANWRRRNRRRGCRPGTACARPPSRHRAGLLPHRTPRRRAADRGRV

SEQ ID NO: 728 - DNA, 403 bp, Mycobacterium tuberculosis
  CDS (1)..(255)
  CDS (265)..(276)
  CDS (280)..(330)
  CDS (334)..(402)
gccggtaacgccgcgtcccagtgctatccgtccgccggaccgcccgaaacatcagcggcgggcgccccggtcggccgcggccgggctcgacccgctccacctggccatcagcgaccaggttatcgaggtggaagcggacggtgttgggatgcacgcccaacttgccggcgatcgcggcgatgctcatcggaacccgcgacgcacacaatgcccgcagcaccgcacgacggcgccccaccggctcttgcagtgacctgatgatgacactcacccccataaggctcgtcggctgcgcctgagcaatgcagtaagtttacacaaacggacttgtaaaaacctgcggaggtggggtctatggccaacaaacgtggcaatgccgggcagcctctgcccttgtcggatc

SEQ ID NO: 729 - protein, 85 aa, Mycobacterium tuberculosis
AGNAASQCYPSAGPPETSAAGAPVGRGRARPAPPGHQRPGYRGGSGRCWDARPTCRRSRRCSSEPATHTMPAAPHDGAPPALAVT

SEQ ID NO: 730 - protein, 4 aa, Mycobacterium tuberculosis
HSPP

SEQ ID NO: 731 - protein, 17 aa, Mycobacterium tuberculosis
GSSAAPEQCSKFTQTDL

SEQ ID NO: 732 - protein, 23 aa, Mycobacterium tuberculosis
KPAEVGSMANKRGNAGQPLPLSD

SEQ ID NO: 733 - DNA, 402 bp, Mycobacterium tuberculosis
  CDS (1)..(249)
  CDS (253)..(402)
ccggtaacgccgcgtcccagtgctatccgtccgccggaccgcccgaaacatcagcggcgggcgccccggtcggccgcggccgggctcgacccgctccacctggccatcagcgaccaggttatcgaggtggaagcggacggtgttgggatgcacgcccaacttgccggcgatcgcggcgatgctcatcggaacccgcgacgcacacaatgcccgcagcaccgcacgacggcgccccaccggctcttgcagtgacctgatgatgacactcacccccataaggctcgtcggctgcgcctgagcaatgcagtaagtttacacaaacggacttgtaaaaacctgcggaggtggggtctatggccaacaaacgtggcaatgccgggcagcctctgcccttgtcggatc

SEQ ID NO: 734 - protein, 83 aa, Mycobacterium tuberculosis
PVTPRPSAIRPPDRPKHQRRAPRSAAAGLDPLHLAISDQVIEVEADGVGMHAQLAGDRGDAHRNPRRTQCPQHRTTAPHRLLQ

SEQ ID NO: 735 - protein, 50 aa, Mycobacterium tuberculosis
PDDDTHPHKARRLRLSNAVSLHKRTCKNLRRWGLWPTNVAMPGSLCPCRI

SEQ ID NO: 736 - DNA, 401 bp, Mycobacterium tuberculosis
  CDS (1)..(3)
  CDS (7)..(294)
  CDS (298)..(306)
  CDS (310)..(399)
cggtaacgccgcgtcccagtgctatccgtccgccggaccgcccgaaacatcagcggcgggcgccccggtcggccgcggccgggctcgacccgctccacctggccatcagcgaccaggttatcgaggtggaagcggacggtgttgggatgcacgcccaacttgccggcgatcgcggcgatgctcatcggaacccgcgacgcacacaatgcccgcagcaccgcacgacggcgccccaccggctcttgcagtgacctgatgatgacactcacccccataaggctcgtcggctgcgcctgagcaatgcagtaagtttacacaaacggacttgtaaaaacctgcggaggtggggtctatggccaacaaacgtggcaatgccgggcagcctctgcccttgtcggatc

SEQ ID NO: 737 - protein, 96 aa, Mycobacterium tuberculosis
RRVPVLSVRRTARNISGGRPGRPRPGSTRSTWPSATRLSRWKRTVLGCTPNLPAIAAMLIGTRDAHNARSTARRRPTGSCSDLMMTLTPIRLVGCA

SEQ ID NO: 738 - protein, 30 aa, Mycobacterium tuberculosis
VYTNGLVKTCGGGVYGQQTWQCRAASALVG

SEQ ID NO: 739 - DNA, 822 bp, Mycobacterium tuberculosis
  CDS (1)..(819)
atggccaacaaacgtggcaatgccgggcagcctctgcccttgtcggatcgagacgacgaccacatgcaggggcactggctgctggcccggctgggcaagcgggtgctgcgtcccggcggcgtcgaactcacccggacactgctggcccgcgccgaggtgaccgacgccgacgtgctcgagctggcaccgggcctgggccgcaccgcagccgaaatcttggcccgcaacccgcggtcgtacgtgggggcggagagcgatcccaacgcggccaacctggtccgacacgttctcgccggccgcggcgacgtccgggtcaccgacgcggccgataccggattatccgacgccagcgccgatgtcgtcatcggcgaggcgatgctgaccatgcaaggcaacgcggctaaacacacgatcgtcgccgaggcggcgcgggtgctgaggccgggtggccgctacgcgattcacgaactagcgctggtgccggacgacgtcgcagagcaggtccgcaccgacctgcggcagtcgctggcccgcgcgctcaaggtcaatgcgcgtccgctgaccgttgcggaatggtcgcacctcttagcgggccatggactggtcgtcgaacacgttgtcaccgcttccatggcgttgttacaaccgcgacgggtgatcgctgacgaaggcctcctgggtgcgctgcggttcgccggaaacctgctcatccatcgtgccgcgcgtcggcgagtcctgttgatgcgccacacattccgcaggcatcgtgaacgcttgacagccgtcgccattgtcgcgcacaaaccgcacgtcgattcgtga

SEQ ID NO: 740 - protein, 273 aa, Mycobacterium tuberculosis
MANKRGNAGQPLPLSDRDDDHMQGHWLLARLGKRVLRPGGVELTRTLLARAEVTDADVLELAPGLGRTAAEILARNPRSYVGAESDPNAANLVRHVLAGRGDVRVTDAADTGLSDASADVVIGEAMLTMQGNAAKHTIVAEAARVLRPGGRYAIHELALVPDDVAEQVRTDLRQSLARALKVNARPLTVAEWSHLLAGHGLVVEHVVTASMALLQPRRVIADEGLLGALRFAGNLLIHRAARRRVLLMRHTFRRHRERLTAVAIVAHKPHVDS

SEQ ID NO: 741 - DNA, 846 bp, Mycobacterium tuberculosis
  CDS (4)..(843)
taaaaacctgcggaggtggggtctatggccaacaaacgtggcaatgccgggcagcctctgcccttgtcggatcgagacgacgaccacatgcaggggcactggctgctggcccggctgggcaagcgggtgctgcgtcccggcggcgtcgaactcacccggacactgctggcccgcgccgaggtgaccgacgccgacgtgctcgagctggcaccgggcctgggccgcaccgcagccgaaatcttggcccgcaacccgcggtcgtacgtgggggcggagagcgatcccaacgcggccaacctggtccgacacgttctcgccggccgcggcgacgtccgggtcaccgacgcggccgataccggattatccgacgccagcgccgatgtcgtcatcggcgaggcgatgctgaccatgcaaggcaacgcggctaaacacacgatcgtcgccgaggcggcgcgggtgctgaggccgggtggccgctacgcgattcacgaactagcgctggtgccggacgacgtcgcagagcaggtccgcaccgacctgcggcagtcgctggcccgcgcgctcaaggtcaatgcgcgtccgctgaccgttgcggaatggtcgcacctcttagcgggccatggactggtcgtcgaacacgttgtcaccgcttccatggcgttgttacaaccgcgacgggtgatcgctgacgaaggcctcctgggtgcgctgcggttcgccggaaacctgctcatccatcgtgccgcgcgtcggcgagtcctgttgatgcgccacacattccgcaggcatcgtgaacgcttgacagccgtcgccattgtcgcgcacaaaccgcacgtcgattcgtga

SEQ ID NO: 742 - protein, 280 aa, Mycobacterium tuberculosis
KPAEVGSMANKRGNAGQPLPLSDRDDDHMQGHWLLARLGKRVLRPGGVELTRTLLARAEVTDADVLELAPGLGRTAAEILARNPRSYVGAESDPNAANLVRHVLAGRGDVRVTDAADTGLSDASADVVIGEAMLTMQGNAAKHTIVAEAARVLRPGGRYAIHELALVPDDVAEQVRTDLRQSLARALKVNARPLTVAEWSHLLAGHGLVVEHVVTASMALLQPRRVIADEGLLGALRFAGNLLIHRAARRRVLLMRHTFRRHRERLTAVAIVAHKPHVDS

SEQ ID NO: 743 - DNA, 300 bp, Mycobacterium tuberculosis
  CDS (1)..(93)
  CDS (97)..(300)
atcgcgcgtgacatcgatgaccagggtcggctgtgtctggacgtcggcggtcgaacggtagttgtttcagcgggcgacgtggtgcatttgcgttaactcgcgcggagctggcgtccccaaaagattaaggtcgcgggcatgagctatccggagaatgtcctggccgctggcgagcaggtcgttctgcaccgccatccgcactggaatcgcttaatctggcccgtcgtggtgctggtcttgctgaccgggttggcggcgttcgggtccggattcgtcaactcgacaccttggcagcagatc

SEQ ID NO: 744 - protein, 31 aa, Mycobacterium tuberculosis
IARDIDDQGRLCLDVGGRTVVVSAGDVVHLR

SEQ ID NO: 745 - protein, 68 aa, Mycobacterium tuberculosis
LARSWRPQKIKVAGMSYPENVLAAGEQVVLHRHPHWNRLIWPVVVLVLLTGLAAFGSGFVNSTPWQQI

SEQ ID NO: 746 - DNA, 299 bp, Mycobacterium tuberculosis
  CDS (1)..(57)
  CDS (61)..(138)
  CDS (142)..(210)
  CDS (214)..(240)
  CDS (244)..(297)
tcgcgcgtgacatcgatgaccagggtcggctgtgtctggacgtcggcggtcgaacggtagttgtttcagcgggcgacgtggtgcatttgcgttaactcgcgcggagctggcgtccccaaaagattaaggtcgcgggcatgagctatccggagaatgtcctggccgctggcgagcaggtcgttctgcaccgccatccgcactggaatcgcttaatctggcccgtcgtggtgctggtcttgctgaccgggttggcggcgttcgggtccggattcgtcaactcgacaccttggcagcagatc

SEQ ID NO: 747 - protein, 19 aa, Mycobacterium tuberculosis
SRVTSMTRVGCVWTSAVER

SEQ ID NO: 748 - protein, 26 aa, Mycobacterium tuberculosis
LFQRATWCICVNSRGAGVPKRLRSRA

SEQ ID NO: 749 - protein, 23 aa, Mycobacterium tuberculosis
AIRRMSWPLASRSFCTAIRTGIA

SEQ ID NO: 750 - protein, 9 aa, Mycobacterium tuberculosis
SGPSWCWSC

SEQ ID NO: 751 - protein, 18 aa, Mycobacterium tuberculosis
PGWRRSGPDSSTRHLGSR

SEQ ID NO: 752 - DNA, 298 bp, Mycobacterium tuberculosis
  CDS (1)..(6)
  CDS (10)..(15)
  CDS (19)..(123)
  CDS (127)..(297)
cgcgcgtgacatcgatgaccagggtcggctgtgtctggacgtcggcggtcgaacggtagttgtttcagcgggcgacgtggtgcatttgcgttaactcgcgcggagctggcgtccccaaaagattaaggtcgcgggcatgagctatccggagaatgtcctggccgctggcgagcaggtcgttctgcaccgccatccgcactggaatcgcttaatctggcccgtcgtggtgctggtcttgctgaccgggttggcggcgttcgggtccggattcgtcaactcgacaccttggcagcagatc

SEQ ID NO: 753 - protein, 35 aa, Mycobacterium tuberculosis
PGSAVSGRRRSNGSCFSGRRGAFALTRAELASPKD

SEQ ID NO: 754 - protein, 57 aa, Mycobacterium tuberculosis
GRGHELSGECPGRWRAGRSAPPSALESLNLARRGAGLADRVGGVRVRIRQLDTLAAD

SEQ ID NO: 755 - DNA, 519 bp, Mycobacterium tuberculosis
  CDS (1)..(516)
atgagctatccggagaatgtcctggccgctggcgagcaggtcgttctgcaccgccatccgcactggaatcgcttaatctggcccgtcgtggtgctggtcttgctgaccgggttggcggcgttcgggtccggattcgtcaactcgacaccttggcagcagatcgctaagaacgtgattcacgcggtcatctgggggatctggttggtgatcgtcggctggctcacgctgtggccattcctgagctggctgaccacacatttcgtggtgaccaaccggcgggtgatgttccggcatggtgtgctgacccgcagcgggatcgacataccgctagcacggatcaacagcgtggagttccgggaccggatcttcgagcggatttttcgcaccgggacgttgattatcgagtccgcgtcacaagatccgctcgagttctacaacattccgcgcctgcgggaggtgcatgcgttgctgtatcacgaggttttcgacaccctgggctccgacgagtcgcccagctga

SEQ ID NO: 756 - protein, 172 aa, Mycobacterium tuberculosis
MSYPENVLAAGEQVVLHRHPHWNRLIWPVVVLVLLTGLAAFGSGFVNSTPWQQIAKNVIHAVIWGIWLVIVGWLTLWPFLSWLTTHFVVTNRRVMFRHGVLTRSGIDIPLARINSVEFRDRIFERIFRTGTLIIESASQDPLEFYNIPRLREVHALLYHEVFDTLGSDESPS

SEQ ID NO: 757 - DNA, 564 bp, Mycobacterium tuberculosis
  CDS (4)..(561)
taactcgcgcggagctggcgtccccaaaagattaaggtcgcgggcatgagctatccggagaatgtcctggccgctggcgagcaggtcgttctgcaccgccatccgcactggaatcgcttaatctggcccgtcgtggtgctggtcttgctgaccgggttggcggcgttcgggtccggattcgtcaactcgacaccttggcagcagatcgctaagaacgtgattcacgcggtcatctgggggatctggttggtgatcgtcggctggctcacgctgtggccattcctgagctggctgaccacacatttcgtggtgaccaaccggcgggtgatgttccggcatggtgtgctgacccgcagcgggatcgacataccgctagcacggatcaacagcgtggagttccgggaccggatcttcgagcggatttttcgcaccgggacgttgattatcgagtccgcgtcacaagatccgctcgagttctacaacattccgcgcctgcgggaggtgcatgcgttgctgtatcacgaggttttcgacaccctgggctccgacgagtcgcccagctga

SEQ ID NO: 758 - protein, 186 aa, Mycobacterium tuberculosis
LARSWRPQKIKVAGMSYPENVLAAGEQVVLHRHPHWNRLIWPVVVLVLLTGLAAFGSGFVNSTPWQQIAKNVIHAVIWGIWLVIVGWLTLWPFLSWLTTHFVVTNRRVMFRHGVLTRSGIDIPLARINSVEFRDRIFERIFRTGTLIIESASQDPLEFYNIPRLREVHALLYHEVFDTLGSDESPS

SEQ ID NO: 759 - DNA, 429 bp, Mycobacterium tuberculosis
  CDS (1)..(429)
gccaagatggatgtctaccaacgcaccgccgccggctggcagccgctcaagaccggtatcaccacccatatcggttcggcgggcatggcgccggaagccaagagcggatatccggccactccgatgggggtttacagcctggactccgcttttggcaccgcgccgaatcccggtggcgggttgccgtatacccaagtcggacccaatcactggtggagtggcgacgacaatagccccacctttaactccatgcaggtctgtcagaagtcccagtgcccgttcagcacggccgacagcgagaacctgcaaatcccgcagtacaagcattcggtcgtgatgggcgtcaacaaggccaaggtcccaggcaaaggctccgcgttcttctttcacaccaccgacggcgggcccaccgcgggttgtgtggcgatc

SEQ ID NO: 760 - protein, 143 aa, Mycobacterium tuberculosis
AKMDVYQRTAAGWQPLKTGITTHIGSAGMAPEAKSGYPATPMGVYSLDSAFGTAPNPGGGLPYTQVGPNHWWSGDDNSPTFNSMQVCQKSQCPFSTADSENLQIPQYKHSVVMGVNKAKVPGKGSAFFFHTTDGGPTAGCVAI

SEQ ID NO: 761 - DNA, 428 bp, Mycobacterium tuberculosis
  CDS (1)..(333)
  CDS (337)..(426)
ccaagatggatgtctaccaacgcaccgccgccggctggcagccgctcaagaccggtatcaccacccatatcggttcggcgggcatggcgccggaagccaagagcggatatccggccactccgatgggggtttacagcctggactccgcttttggcaccgcgccgaatcccggtggcgggttgccgtatacccaagtcggacccaatcactggtggagtggcgacgacaatagccccacctttaactccatgcaggtctgtcagaagtcccagtgcccgttcagcacggccgacagcgagaacctgcaaatcccgcagtacaagcattcggtcgtgatgggcgtcaacaaggccaaggtcccaggcaaaggctccgcgttcttctttcacaccaccgacggcgggcccaccgcgggttgtgtggcgatc

SEQ ID NO: 762 - protein, 111 aa, Mycobacterium tuberculosis
PRWMSTNAPPPAGSRSRPVSPPISVRRAWRRKPRADIRPLRWGFTAWTPLLAPRRIPVAGCRIPKSDPITGGVATTIAPPLTPCRSVRSPSARSARPTARTCKSRSTSIRS

SEQ ID NO: 763 - protein, 30 aa, Mycobacterium tuberculosis
WASTRPRSQAKAPRSSFTPPTAGPPRVVWR

SEQ ID NO: 764 - DNA, 427 bp, Mycobacterium tuberculosis
  CDS (1)..(228)
  CDS (232)..(240)
  CDS (244)..(426)
caagatggatgtctaccaacgcaccgccgccggctggcagccgctcaagaccggtatcaccacccatatcggttcggcgggcatggcgccggaagccaagagcggatatccggccactccgatgggggtttacagcctggactccgcttttggcaccgcgccgaatcccggtggcgggttgccgtatacccaagtcggacccaatcactggtggagtggcgacgacaatagccccacctttaactccatgcaggtctgtcagaagtcccagtgcccgttcagcacggccgacagcgagaacctgcaaatcccgcagtacaagcattcggtcgtgatgggcgtcaacaaggccaaggtcccaggcaaaggctccgcgttcttctttcacaccaccgacggcgggcccaccgcgggttgtgtggcgatc

SEQ ID NO: 765 - protein, 76 aa, Mycobacterium tuberculosis
QDGCLPTHRRRLAAAQDRYHHPYRFGGHGAGSQERISGHSDGGLQPGLRFWHRAESRWRVAVYPSRTQSLVEWRRQ

SEQ ID NO: 766 - protein, 61 aa, Mycobacterium tuberculosis
LHAGLSEVPVPVQHGRQREPANPAVQAFGRDGRQQGQGPRQRLRVLLSHHRRRAHRGLCGD

SEQ ID NO: 767 - DNA, 657 bp, Mycobacterium tuberculosis
  CDS (1)..(654)
atgagccgactcctagctttgctgtgcgctgcggtatgcacgggctgcgttgctgtggttctcgcgccagtgagcctggccgtcgtcaacccgtggttcgcgaactcggtcggcaatgccactcaggtggtttcggtggtgggaaccggcggttcgacggccaagatggatgtctaccaacgcaccgccgccggctggcagccgctcaagaccggtatcaccacccatatcggttcggcgggcatggcgccggaagccaagagcggatatccggccactccgatgggggtttacagcctggactccgcttttggcaccgcgccgaatcccggtggcgggttgccgtatacccaagtcggacccaatcactggtggagtggcgacgacaatagccccacctttaactccatgcaggtctgtcagaagtcccagtgcccgttcagcacggccgacagcgagaacctgcaaatcccgcagtacaagcattcggtcgtgatgggcgtcaacaaggccaaggtcccaggcaaaggctccgcgttcttctttcacaccaccgacggcgggcccaccgcgggttgtgtggcgatcgacgatgccacgctggtgcagatcatccgttggctgcggcctggtgcggtgatcgcgatcgccaagtaa

SEQ ID NO: 768 - protein, 218 aa, Mycobacterium tuberculosis
MSRLLALLCAAVCTGCVAVVLAPVSLAVVNPWFANSVGNATQVVSVVGTGGSTAKMDVYQRTAAGWQPLKTGITTHIGSAGMAPEAKSGYPATPMGVYSLDSAFGTAPNPGGGLPYTQVGPNHWWSGDDNSPTFNSMQVCQKSQCPFSTADSENLQIPQYKHSVVMGVNKAKVPGKGSAFFFHTTDGGPTAGCVAIDDATLVQIIRWLRPGAVIAIAK

SEQ ID NO: 769 - DNA, 663 bp, Mycobacterium tuberculosis
  CDS (4)..(660)
tgagcgatgagccgactcctagctttgctgtgcgctgcggtatgcacgggctgcgttgctgtggttctcgcgccagtgagcctggccgtcgtcaacccgtggttcgcgaactcggtcggcaatgccactcaggtggtttcggtggtgggaaccggcggttcgacggccaagatggatgtctaccaacgcaccgccgccggctggcagccgctcaagaccggtatcaccacccatatcggttcggcgggcatggcgccggaagccaagagcggatatccggccactccgatgggggtttacagcctggactccgcttttggcaccgcgccgaatcccggtggcgggttgccgtatacccaagtcggacccaatcactggtggagtggcgacgacaatagccccacctttaactccatgcaggtctgtcagaagtcccagtgcccgttcagcacggccgacagcgagaacctgcaaatcccgcagtacaagcattcggtcgtgatgggcgtcaacaaggccaaggtcccaggcaaaggctccgcgttcttctttcacaccaccgacggcgggcccaccgcgggttgtgtggcgatcgacgatgccacgctggtgcagatcatccgttggctgcggcctggtgcggtgatcgcgatcgccaagtaa

SEQ ID NO: 770 - protein, 219 aa, Mycobacterium tuberculosis
AMSRLLALLCAAVCTGCVAVVLAPVSLAVVNPWFANSVGNATQVVSVVGTGGSTAKMDVYQRTAAGWQPLKTGITTHIGSAGMAPEAKSGYPATPMGVYSLDSAFGTAPNPGGGLPYTQVGPNHWWSGDDNSPTFNSMQVCQKSQCPFSTADSENLQIPQYKHSVVMGVNKAKVPGKGSAFFFHTTDGGPTAGCVAIDDATLVQIIRWLRPGAVIAIAK

SEQ ID NO: 771 - DNA, 1492 bp, Mycobacterium tuberculosis
  CDS (1)..(147)
  CDS (151)..(228)
  CDS (232)..(285)
  CDS (289)..(438)
  CDS (442)..(477)
  CDS (481)..(576)
  CDS (580)..(759)
  CDS (763)..(912)
  CDS (916)..(1023)
  CDS (1027)..(1038)
  CDS (1042)..(1186)
  CDS (1190)..(1491)
gatctccccggacaccaggtcatccggcgagatggtgatcgaggctcggacccgcaggcatccggtagccagaggcaccagcatcagcaacatcgcgatggccagcatgccgcgccgtcgggtccttgccactcgcgatccttgggatgacggtggggcatagctagcgcgcaccaggtcatcgtgccagaccgggcatgccgcgtcggcaagctgtcgggcgcgggttagagcggtagcgtgcgacccaggatggcgaatgctcgggggtcaccggcgaagtggtagccgcggatgatgtcggtgaagcccaaccggcggtacaaccgccacgcccgattgtcctcaccgttggtctccggtgtggagagcaggacgttgtcctcgtcgcgaccggctagcagtcggcgggccaacgcctccccgaggccacggccttgagcgcggggaaggatgtgcaattcagtcaactcgaagtagctggtcatcagtcgggcgatcgctaggcgcggaaagccgctgcgttgcaagcccagtaccacctgctgttgccaccactggccgggcgccccgggatagccgtacgccactccgagcattggcgcgttgctcagttcggcggccgacggcagcgccgtggtgtcggcggcctcggcctgttcggctgccgttacctcgacggccgcgaccgcctgccagccgcgccgccggatgtgctccagccacattggggcgcgcaaagtctcggtgcccctggggtagcgcatcgcgtcgacatacaccgtcagggcatcaccgaggcggcgctccatatcgctgggcggcagatcgatgaggaatatcgccaacgcgcggtgtcctcctcatgtgatgaaccgatgcgtgcttgcgcaccagtatcggacaagccgatgaggccgcccgcgctggacggggcttgtagcgtatggccgtttccgctcagctcgtcgctgcggcgccgccgggatagaatcgcccgcgaaccagtggtacggcgcagattgacctcgtatcatctgagttagttgcccgcgcaatgggcatccgcgtgttatcggtattacgtgacagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 772 - protein, 49 aa, Mycobacterium tuberculosis
DLPGHQVIRRDGDRGSDPQASGSQRHQHQQHRDGQHAAPSGPCHSRSLG

SEQ ID NO: 773 - protein, 26 aa, Mycobacterium tuberculosis
RWGIASAHQVIVPDRACRVGKLSGAG

SEQ ID NO: 774 - protein, 18 aa, Mycobacterium tuberculosis
SGSVRPRMANARGSPAKW

SEQ ID NO: 775 - protein, 50 aa, Mycobacterium tuberculosis
PRMMSVKPNRRYNRHARLSSPLVSGVESRTLSSSRPASSRRANASPRPRP

SEQ ID NO: 776 - protein, 12 aa, Mycobacterium tuberculosis
ARGRMCNSVNSK

SEQ ID NO: 777 - protein, 32 aa, Mycobacterium tuberculosis
LVISRAIARRGKPLRCKPSTTCCCHHWPGAPG

SEQ ID NO: 778 - protein, 60 aa, Mycobacterium tuberculosis
PYATPSIGALLSSAADGSAVVSAASACSAAVTSTAATACQPRRRMCSSHIGARKVSVPLG

SEQ ID NO: 779 - protein, 50 aa, Mycobacterium tuberculosis
RIASTYTVRASPRRRSISLGGRSMRNIANARCPPHVMNRCVLAHQYRTSR

SEQ ID NO: 780 - protein, 36 aa, Mycobacterium tuberculosis
GRPRWTGLVAYGRFRSARRCGAAGIESPANQWYGAD

SEQ ID NO: 781 - protein, 4 aa, Mycobacterium tuberculosis
PRII

SEQ ID NO: 782 - protein, 15 aa, Mycobacterium tuberculosis
VSCPRNGHPRVIGIT

SEQ ID NO: 783 - protein, 134 aa, Mycobacterium tuberculosis; identical to SEQ ID NO: 599

SEQ ID NO: 784 - DNA, 1491 bp, Mycobacterium tuberculosis
  CDS (1)..(159)
  CDS (163)..(294)
  CDS (298)..(303)
  CDS (307)..(831)
  CDS (835)..(867)
  CDS (874)..(939)
  CDS (943)..(987)
  CDS (991)..(1308)
  CDS (1312)..(1350)
  CDS (1354)..(1491)
atctccccggacaccaggtcatccggcgagatggtgatcgaggctcggacccgcaggcatccggtagccagaggcaccagcatcagcaacatcgcgatggccagcatgccgcgccgtcgggtccttgccactcgcgatccttgggatgacggtggggcatagctagcgcgcaccaggtcatcgtgccagaccgggcatgccgcgtcggcaagctgtcgggcgcgggttagagcggtagcgtgcgacccaggatggcgaatgctcgggggtcaccggcgaagtggtagccgcggatgatgtcggtgaagcccaaccggcggtacaaccgccacgcccgattgtcctcaccgttggtctccggtgtggagagcaggacgttgtcctcgtcgcgaccggctagcagtcggcgggccaacgcctccccgaggccacggccttgagcgcggggaaggatgtgcaattcagtcaactcgaagtagctggtcatcagtcgggcgatcgctaggcgcggaaagccgctgcgttgcaagcccagtaccacctgctgttgccaccactggccgggcgccccgggatagccgtacgccactccgagcattggcgcgttgctcagttcggcggccgacggcagcgccgtggtgtcggcggcctcggcctgttcggctgccgttacctcgacggccgcgaccgcctgccagccgcgccgccggatgtgctccagccacattggggcgcgcaaagtctcggtgcccctggggtagcgcatcgcgtcgacatacaccgtcagggcatcaccgaggcggcgctccatatcgctgggcggcagatcgatgaggaatatcgccaacgcgcggtgtcctcctcatgtgatgaaccgatgcgtgcttgcgcaccagtatcggacaagccgatgaggccgcccgcgctggacggggcttgtagcgtatggccgtttccgctcagctcgtcgctgcggcgccgccgggatagaatcgcccgcgaaccagtggtacggcgcagattgacctcgtatcatctgagttagttgcccgcgcaatgggcatccgcgtgttatcggtattacgtgacagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 785 - protein, 53 aa, Mycobacterium tuberculosis
ISPDTRSSGEMVIEARTRRHPVARGTSISNIAMASMPRRRVLATRDPWDDGGA

SEQ ID NO: 786 - protein, 44 aa, Mycobacterium tuberculosis
LARTRSSCQTGHAASASCRARVRAVACDPGWRMLGGHRRSGSRG

SEQ ID NO: 787 - protein, 175 aa, Mycobacterium tuberculosis
SPTGGTTATPDCPHRWSPVWRAGRCPRRDRLAVGGPTPPRGHGLERGEGCAIQSTRSSWSSVGRSLGAESRCVASPVPPAVATTGRAPRDSRTPLRALARCSVRRPTAAPWCRRPRPVRLPLPRRPRPPASRAAGCAPATLGRAKSRCPWGSASRRHTPSGHHRGGAPYRWAADR

SEQ ID NO: 788 - protein, 11 aa, Mycobacterium tuberculosis
GISPTRGVLLM

SEQ ID NO: 789 - protein, 22 aa, Mycobacterium tuberculosis
TDACLRTSIGQADEAARAGRGL

SEQ ID NO: 790 - protein, 15 aa, Mycobacterium tuberculosis
RMAVSAQLVAAAPPG

SEQ ID NO: 791 - protein, 106 aa, Mycobacterium tuberculosis
NRPRTSGTAQIDLVSSELVARAMGIRVLSVLRDSLSARRDACHSPIMSSGCLTRSRALSTPKIPSSHRVSVAGASAHRPRGGACRARRCSSSVWGCWFPAWRSKRP

SEQ ID NO: 792 - protein, 13 aa, Mycobacterium tuberculosis
SEVSRYSAFSVLS

SEQ ID NO: 793 - protein, 46 aa, Mycobacterium tuberculosis; identical to SEQ ID NO: 603

SEQ ID NO: 794 - DNA, 1490 bp, Mycobacterium tuberculosis
  CDS (1)..(33)
  CDS (37)..(63)
  CDS (67)..(162)
  CDS (166)..(234)
  CDS (238)..(396)
  CDS (400)..(501)
  CDS (505)..(1141)
  CDS (1045)..(1128)
  CDS (1132)..(1143)
  CDS (1147)..(1488)
tctccccggacaccaggtcatccggcgagatggtgatcgaggctcggacccgcaggcatccggtagccagaggcaccagcatcagcaacatcgcgatggccagcatgccgcgccgtcgggtccttgccactcgcgatccttgggatgacggtggggcatagctagcgcgcaccaggtcatcgtgccagaccgggcatgccgcgtcggcaagctgtcgggcgcgggttagagcggtagcgtgcgacccaggatggcgaatgctcgggggtcaccggcgaagtggtagccgcggatgatgtcggtgaagcccaaccggcggtacaaccgccacgcccgattgtcctcaccgttggtctccggtgtggagagcaggacgttgtcctcgtcgcgaccggctagcagtcggcgggccaacgcctccccgaggccacggccttgagcgcggggaaggatgtgcaattcagtcaactcgaagtagctggtcatcagtcgggcgatcgctaggcgcggaaagccgctgcgttgcaagcccagtaccacctgctgttgccaccactggccgggcgccccgggatagccgtacgccactccgagcattggcgcgttgctcagttcggcggccgacggcagcgccgtggtgtcggcggcctcggcctgttcggctgccgttacctcgacggccgcgaccgcctgccagccgcgccgccggatgtgctccagccacattggggcgcgcaaagtctcggtgcccctggggtagcgcatcgcgtcgacatacaccgtcagggcatcaccgaggcggcgctccatatcgctgggcggcagatcgatgaggaatatcgccaacgcgcggtgtcctcctcatgtgatgaaccgatgcgtgcttgcgcaccagtatcggacaagccgatgaggccgcccgcgctggacggggcttgtagcgtatggccgtttccgctcagctcgtcgctgcggcgccgccgggatagaatcgcccgcgaaccagtggtacggcgcagattgacctcgtatcatctgagttagttgcccgcgcaatgggcatccgcgtgttatcggtattacgtgacagtctgtcggcaaggagggacgcatgccactctccgatcatgagcagcggatgcttgaccagatcgagagcgctctctacgccgaagatcccaagttcgcatcgagtgtccgtggcgggggcttccgcgcaccgaccgcgcggcggcgcctgcagggcgcggcgttgttcatcatcggtctggggatgttggtttccggcgtggcgttcaaagagaccatgatcggaagtttcccgatactcagcgttttcggttttgtcgtgatgttcggtggtgtggtgtatgccatcaccggtcctcggttgtccggcaggatggatcgtggcggatcggctgctggggcttcgcgccagcgtcgtaccaagggggccgggggctcattcaccagccgtatggaagatc

SEQ ID NO: 795 - protein, 11 aa, Mycobacterium tuberculosis
SPRTPGHPARW

SEQ ID NO: 796 - protein, 9 aa, Mycobacterium tuberculosis
SRLGPAGIR

SEQ ID NO: 797 - protein, 32 aa, Mycobacterium tuberculosis
PEAPASATSRWPACRAVGSLPLAILGMTVGHS

SEQ ID NO: 798 - protein, 23 aa, Mycobacterium tuberculosis
RAPGHRARPGMPRRQAVGRGLER

SEQ ID NO: 799 - protein, 53 aa, Mycobacterium tuberculosis
RATQDGECSGVTGEVVAADDVGEAQPAVQPPRPIVLTVGLRCGEQDVVLVATG

SEQ ID NO: 800 - protein, 34 aa, Mycobacterium tuberculosis
QSAGQRLPEATALSAGKDVQFSQLEVAGHQSGDR

SEQ ID NO: 801 - protein, 179 aa, Mycobacterium tuberculosis
ARKAAALQAQYHLLLPPLAGRPGIAVRHSEHWRVAQFGGRRQRRGVGGLGLFGCRYLDGRDRLPAAPPDVLQPHWGAQSLGAPGVAHRVDIHRQGITEAALHIAGRQIDEEYRQRAVSSSCDEPMRACAPVSDKPMRPPALDGACSVWPFPLSSSLRRRRDRIAREPVVRRRLTSYHLS

SEQ ID NO: 802 - protein, 28 aa, Mycobacterium tuberculosis
LPAQWASACYRYYVTVCRQGGTHATLRS

SEQ ID NO: 803 - protein, 4 aa, Mycobacterium tuberculosis
AADA

SEQ ID NO: 804 - protein, 114 aa, Mycobacterium tuberculosis; identical to SEQ ID NO: 607

SEQ ID NO: 805 - DNA, 403 bp, Mycobacterium tuberculosis; identical to SEQ ID NO: 598
  CDS (1)..(402)

SEQ ID NO: 806 - protein, 134 aa, Mycobacterium tuberculosis; identical to SEQ ID NO: 599

SEQ ID NO: 807 - DNA, 405 bp, Mycobacterium tuberculosis; identical to SEQ ID NO: 608
  CDS (1)..(402)

SEQ ID NO: 808 - protein, 134 aa, Mycobacterium tuberculosis; identical to SEQ ID NO: 609

SEQ ID NO: 809 - DNA, 432 bp, Mycobacterium tuberculosis; identical to SEQ ID NO: 610
  CDS (4)..(429)

SEQ ID NO: 810 - protein, 142 aa, Mycobacterium tuberculosis; identical to SEQ ID NO: 611

SEQ ID NO: 811 - DNA, 360 bp, Mycobacterium tuberculosis
  CDS (1)..(360)
cagccgcgccgcatcgaccagggcctcacgcccggtcacttctccgcgttcctcaacaattccggtgaacatcgcaccaggttaggcagcaatcccgcggacccgcaccccactcgccgaccggccaactcacagacaccctctacgatgcagggtatgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatc

SEQ ID NO: 812 - protein, 120 aa, Mycobacterium tuberculosis
QPRRIDQGLTPGHFSAFLNNSGEHRTRLGSNPADPHPTRRPANSQTPSTMQGMRTPRRHCRRIAVLAAVSIAATVVAGCSSGSKPSGGPLPDAKPLVEEATAQTKALKSAHMVLTVNGKI

SEQ ID NO: 813 - DNA, 359 bp, Mycobacterium tuberculosis
  CDS (1)..(81)
  CDS (85)..(339)
  CDS (343)..(357)
agccgcgccgcatcgaccagggcctcacgcccggtcacttctccgcgttcctcaacaattccggtgaacatcgcaccaggttaggcagcaatcccgcggacccgcaccccactcgccgaccggccaactcacagacaccctctacgatgcagggtatgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatc

SEQ ID NO: 814 - protein, 27 aa, Mycobacterium tuberculosis
SRAASTRASRPVTSPRSSTIPVNIAPG

SEQ ID NO: 815 - protein, 85 aa, Mycobacterium tuberculosis
AAIPRTRTPLADRPTHRHPLRCRVCGPPDATAVASPSSPPLASPPLSLPAARRARSQAADHFRTRSRWSRRPPRRPRLSRARTWC

SEQ ID NO: 816 - protein, 5 aa, Mycobacterium tuberculosis
RSTAR

SEQ ID NO: 817 - DNA, 358 bp, Mycobacterium tuberculosis
  CDS (1)..(63)
  CDS (67)..(204)
  CDS (208)..(357)
gccgcgccgcatcgaccagggcctcacgcccggtcacttctccgcgttcctcaacaattccggtgaacatcgcaccaggttaggcagcaatcccgcggacccgcaccccactcgccgaccggccaactcacagacaccctctacgatgcagggtatgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatc

SEQ ID NO: 818 - protein, 21 aa, Mycobacterium tuberculosis
AAPHRPGPHARSLLRVPQQFR

SEQ ID NO: 819 - protein, 46 aa, Mycobacterium tuberculosis
TSHQVRQQSRGPAPHSPTGQLTDTLYDAGYADPQTPLPSHRRPRRR

SEQ ID NO: 820 - protein, 50 aa, Mycobacterium tuberculosis
HRRHCRCRLLVGLEAKRRTTSGREAAGRGGHRADQGSQERAHGADGQRQD

SEQ ID NO: 821 - DNA, 711 bp, Mycobacterium tuberculosis
  CDS (1)..(708)
atgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatcccgggactgtctctgaagacgctgagcggcgatctcaccaccaaccccaccgccgcgacgggaaacgtcaagctcacgctgggtgggtctgatatcgatgccgacttcgtggtgttcgacgggatcctgtacgccaccctgacgcccaaccagtggagcgatttcggtcccgccgccgacatctacgaccccgcccaggtgctgaatccggataccggcctggccaacgtgctggcgaatttcgccgacgcaaaagccgaagggcgggataccatcaacggccagaacaccatccgcatcagcgggaaggtatcggcacaggcggtgaaccagatagcgccgccgttcaacgcgacgcagccggtgccggcgaccgtctggattcaggagaccggcgatcatcaactggcacaggcccagttggaccgcggctcgggcaattccgtccagatgaccttgtcgaaatggggcgagaaggtccaggtcacgaagcccccggtgagctga

SEQ ID NO: 822 - protein, 236 aa, Mycobacterium tuberculosis
MRTPRRHCRRIAVLAAVSIAATVVAGCSSGSKPSGGPLPDAKPLVEEATAQTKALKSAHMVLTVNGKIPGLSLKTLSGDLTTNPTAATGNVKLTLGGSDIDADFVVFDGILYATLTPNQWSDFGPAADIYDPAQVLNPDTGLANVLANFADAKAEGRDTINGQNTIRISGKVSAQAVNQIAPPFNATQPVPATVWIQETGDHQLAQAQLDRGSGNSVQMTLSKWGEKVQVTKPPVS

SEQ ID NO: 823 - DNA, 1023 bp, Mycobacterium tuberculosis
  CDS (4)..(1020)
tagctcacccaggttggaccggttcagtgtctcggccatcacgtcggcggtgaattggccgtcgggcaatacatcgacgaccgtcagacacacgccgttgacagcgatcgagtcgccgtggccggcgtcggcggtaaccatcggaccgcggatggtcagccgcgccgcatcgaccagggcctcacgcccggtcacttctccgcgttcctcaacaattccggtgaacatcgcaccaggttaggcagcaatcccgcggacccgcaccccactcgccgaccggccaactcacagacaccctctacgatgcagggtatgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatcccgggactgtctctgaagacgctgagcggcgatctcaccaccaaccccaccgccgcgacgggaaacgtcaagctcacgctgggtgggtctgatatcgatgccgacttcgtggtgttcgacgggatcctgtacgccaccctgacgcccaaccagtggagcgatttcggtcccgccgccgacatctacgaccccgcccaggtgctgaatccggataccggcctggccaacgtgctggcgaatttcgccgacgcaaaagccgaagggcgggataccatcaacggccagaacaccatccgcatcagcgggaaggtatcggcacaggcggtgaaccagatagcgccgccgttcaacgcgacgcagccggtgccggcgaccgtctggattcaggagaccggcgatcatcaactggcacaggcccagttggaccgcggctcgggcaattccgtccagatgaccttgtcgaaatggggcgagaaggtccaggtcacgaagcccccggtgagctga

SEQ ID NO: 824 - protein, 339 aa, Mycobacterium tuberculosis
LTQVGPVQCLGHHVGGELAVGQYIDDRQTHAVDSDRVAVAGVGGNHRTADGQPRRIDQGLTPGHFSAFLNNSGEHRTRLGSNPADPHPTRRPANSQTPSTMQGMRTPRRHCRRIAVLAAVSIAATVVAGCSSGSKPSGGPLPDAKPLVEEATAQTKALKSAHMVLTVNGKIPGLSLKTLSGDLTTNPTAATGNVKLTLGGSDIDADFVVFDGILYATLTPNQWSDFGPAADIYDPAQVLNPDTGLANVLANFADAKAEGRDTINGQNTIRISGKVSAQAVNQIAPPFNATQPVPATVWIQETGDHQLAQAQLDRGSGNSVQMTLSKWGEKVQVTKPPVS

SEQ ID NO: 825 - DNA, 358 bp, Mycobacterium tuberculosis
  CDS (1)..(357)
gagctggtcaacggcgccggcatcgacgacgccgccgtcgtgacctgccggccggacagcctggccgatgcccagcagatggtcgaggcggcactgggccgatatggccgtttggacggagtgttggtggcctcgggcagcaaccatgtggcgcccattaccgagatggccgtcgaggacttcgacgctgtgatggacgcgaacgtgcggggtgcctggctggtgtgtcgggcggccggacgggtgctgctcgagcagggtcagggcggcagcgtggtgctggtgtcgtccgttcgcggcgggttgggcaatgccgccggttacagcgcgtactgcccgtcgaaggcgggcaccgatc

SEQ ID NO: 826 - protein, 119 aa, Mycobacterium tuberculosis
ELVNGAGIDDAAVVTCRPDSLADAQQMVEAALGRYGRLDGVLVASGSNHVAPITEMAVEDFDAVMDANVRGAWLVCRAAGRVLLEQGQGGSVVLVSSVRGGLGNAAGYSAYCPSKAGTD

SEQ ID NO: 827 - DNA, 357 bp, Mycobacterium tuberculosis
  CDS (1)..(39)
  CDS (43)..(189)
  CDS (193)..(357)
agctggtcaacggcgccggcatcgacgacgccgccgtcgtgacctgccggccggacagcctggccgatgcccagcagatggtcgaggcggcactgggccgatatggccgtttggacggagtgttggtggcctcgggcagcaaccatgtggcgcccattaccgagatggccgtcgaggacttcgacgctgtgatggacgcgaacgtgcggggtgcctggctggtgtgtcgggcggccggacgggtgctgctcgagcagggtcagggcggcagcgtggtgctggtgtcgtccgttcgcggcgggttgggcaatgccgccggttacagcgcgtactgcccgtcgaaggcgggcaccgatc

SEQ ID NO: 828 - protein, 13 aa, Mycobacterium tuberculosis
SWSTAPASTTPPS

SEQ ID NO: 829 - protein, 49 aa, Mycobacterium tuberculosis
PAGRTAWPMPSRWSRRHWADMAVWTECWWPRAATMWRPLPRWPSRTSTL

SEQ ID NO: 830 - protein, 55 aa, Mycobacterium tuberculosis
WTRTCGVPGWCVGRPDGCCSSRVRAAAWCWCRPFAAGWAMPPVTARTARRRRAPI

SEQ ID NO: 831 - DNA, 356 bp, Mycobacterium tuberculosis
  CDS (1)..(354)
gctggtcaacggcgccggcatcgacgacgccgccgtcgtgacctgccggccggacagcctggccgatgcccagcagatggtcgaggcggcactgggccgatatggccgtttggacggagtgttggtggcctcgggcagcaaccatgtggcgcccattaccgagatggccgtcgaggacttcgacgctgtgatggacgcgaacgtgcggggtgcctggctggtgtgtcgggcggccggacgggtgctgctcgagcagggtcagggcggcagcgtggtgctggtgtcgtccgttcgcggcgggttgggcaatgccgccggttacagcgcgtactgcccgtcgaaggcgggcaccgatc

SEQ ID NO: 832 - protein, 118 aa, Mycobacterium tuberculosis
AGQRRRHRRRRRRDLPAGQPGRCPADGRGGTGPIWPFGRSVGGLGQQPCGAHYRDGRRGLRRCDGRERAGCLAGVSGGRTGAARAGSGRQRGAGVVRSRRVGQCRRLQRVLPVEGGHR

SEQ ID NO: 833 - DNA, 813 bp, Mycobacterium tuberculosis
  CDS (1)..(810)
gtggaggaaatggcgctggctcagcaggtgccgaacctgggtctggcgcgcttcagcgtgcaggacaagtcgatcctgatcaccggcgcgaccggttcgttgggccgagttgccgcccgggcgctggccgacgcgggagcgcggctgacactggccggcggcaactcggccggtctggccgagctggtcaacggcgccggcatcgacgacgccgccgtcgtgacctgccggccggacagcctggccgatgcccagcagatggtcgaggcggcactgggccgatatggccgtttggacggagtgttggtggcctcgggcagcaaccatgtggcgcccattaccgagatggccgtcgaggacttcgacgctgtgatggacgcgaacgtgcggggtgcctggctggtgtgtcgggcggccggacgggtgctgctcgagcagggtcagggcggcagcgtggtgctggtgtcgtccgttcgcggcgggttgggcaatgccgccggttacagcgcgtactgcccgtcgaaggcgggcaccgatctgttggccaagacattggcggccgaatggggcggtcacggcattcgggtgaacgcgctggcgccgacggtgtttcggtccgcggtgaccgagtggatgttcaccgacgatccgaagggccgggccacccgggaggcgatgctcgcccggatcccgttgcgccgcttcgccgaaccggaagacttcgtcggcgccctgatctatctgctcagcgacgcctcgagcttctacaccggccaggtgatgtatctggacggcgggtacaccgcatgctga

SEQ ID NO: 834 - protein, 270 aa, Mycobacterium tuberculosis
VEEMALAQQVPNLGLARFSVQDKSILITGATGSLGRVAARALADAGARLTLAGGNSAGLAELVNGAGIDDAAVVTCRPDSLADAQQMVEAALGRYGRLDGVLVASGSNHVAPITEMAVEDFDAVMDANVRGAWLVCRAAGRVLLEQGQGGSVVLVSSVRGGLGNAAGYSAYCPSKAGTDLLAKTLAAEWGGHGIRVNALAPTVFRSAVTEWMFTDDPKGRATREAMLARIPLRRFAEPEDFVGALIYLLSDASSFYTGQVMYLDGGYTAC

SEQ ID NO: 835 - DNA, 816 bp, Mycobacterium tuberculosis
  CDS (4)..(813)
taggtggaggaaatggcgctggctcagcaggtgccgaacctgggtctggcgcgcttcagcgtgcaggacaagtcgatcctgatcaccggcgcgaccggttcgttgggccgagttgccgcccgggcgctggccgacgcgggagcgcggctgacactggccggcggcaactcggccggtctggccgagctggtcaacggcgccggcatcgacgacgccgccgtcgtgacctgccggccggacagcctggccgatgcccagcagatggtcgaggcggcactgggccgatatggccgtttggacggagtgttggtggcctcgggcagcaaccatgtggcgcccattaccgagatggccgtcgaggacttcgacgctgtgatggacgcgaacgtgcggggtgcctggctggtgtgtcgggcggccggacgggtgctgctcgagcagggtcagggcggcagcgtggtgctggtgtcgtccgttcgcggcgggttgggcaatgccgccggttacagcgcgtactgcccgtcgaaggcgggcaccgatctgttggccaagacattggcggccgaatggggcggtcacggcattcgggtgaacgcgctggcgccgacggtgtttcggtccgcggtgaccgagtggatgttcaccgacgatccgaagggccgggccacccgggaggcgatgctcgcccggatcccgttgcgccgcttcgccgaaccggaagacttcgtcggcgccctgatctatctgctcagcgacgcctcgagcttctacaccggccaggtgatgtatctggacggcgggtacaccgcatgctga

SEQ ID NO: 836 - protein, 270 aa, Mycobacterium tuberculosis; identical to SEQ ID NO: 834

SEQ ID NO: 837 - DNA, 94 bp, Mycobacterium tuberculosis
  CDS (1)..(93)
aggctcatgagcaagacggttctcatccttggcgcgggtgtcggcggcctgaccaccgccgacaccctccgtcaactgctaccacctgaggatc

SEQ ID NO: 838 - protein, 31 aa, Mycobacterium tuberculosis
RLMSKTVLILGAGVGGLTTADTLRQLLPPED

SEQ ID NO: 839 - DNA, 93 bp, Mycobacterium tuberculosis
  CDS (1)..(6)
  CDS (10)..(48)
  CDS (52)..(93)
ggctcatgagcaagacggttctcatccttggcgcgggtgtcggcggcctgaccaccgccgacaccctccgtcaactgctaccacctgaggatc

SEQ ID NO: 840 - protein, 13 aa, Mycobacterium tuberculosis
ARRFSSLARVSAA

SEQ ID NO: 841 - protein, 14 aa, Mycobacterium tuberculosis
PPPTPSVNCYHLRI

SEQ ID NO: 842 - DNA, 92 bp, Mycobacterium tuberculosis
  CDS (1)..(84)
  CDS (88)..(90)
gctcatgagcaagacggttctcatccttggcgcgggtgtcggcggcctgaccaccgccgacaccctccgtcaactgctaccacctgaggatc

SEQ ID NO: 843 - protein, 28 aa, Mycobacterium tuberculosis
AHEQDGSHPWRGCRRPDHRRHPPSTATT

SEQ ID NO: 844 - DNA, 1167 bp, Mycobacterium tuberculosis
  CDS (1)..(1164)
atgagcaagacggttctcatccttggcgcgggtgtcggcggcctgaccaccgccgacaccctccgtcaactgctaccacctgaggatcgaatcatattggtggacaggagctttgacgggacgctgggcttgtcgttgctatgggtgttgcggggctggcggcggcctgacgacgtccgcgtccgccccaccgcggcgtcgctgcccggtgtggaaatggttactgcaaccgtcgcccacattgacatcgcggcccaggtagtgcacaccgacaacagcgtcatcggctatgacgcgttggtgatcgcattaggtgcggcgctgaacaccgacgccgttcccggactgtcggacgcgctcgacgccgacgtcgcgggccagttctacaccctggacggcgcggctgagctgcgtgcgaaggtcgaggcgctcgagcatggccggatcgctgtggctatcgccggggtgccgttcaaatgcccagccgcaccgttcgaagcggcgtttctgatcgccgcccaactcggtgaccgctacgccaccggaaccgtacagatcgacacgttcacgcctgacccgctgccgatgcccgttgcaggtcccgaggtcggcgaggctttggtctcgatgctcaaggatcacggtgtcggcttccatcctcgcaaggccctagctcgcgtcgatgaggccgcaaggacgatgcacttcggtgacggcacgtccgaaccgttcgatctgcttgccgtggtccccccgcacgtgccctccgccgcggcgcggtcagcgggtctcagcgaatccgggtggatacccgtggacccgcgcaccctgtccactagcgccgacaacgtgtgggccatcggcgatgcgaccgtgctgacgctgccgaatggcaaaccgctgcccaaggctgccgtgttcgccgaagcccaggccgcagttgtcgcccacggcgtcgcccgccatctcggttacgacgtagctgagcgccacttcaccggcacgggcgcctgctacgtcgagaccggtgatcaccaggcagccaagggcgacggcgatttcttcgctccgtcggcgccctcggtgacgctgtacccgccgtcgcgggagtttcacgaggagaaggtcgcacaagaactggcctggctgacccgctggaagacgtga

SEQ ID NO: 845 - protein, 388 aa, Mycobacterium tuberculosis
MSKTVLILGAGVGGLTTADTLRQLLPPEDRIILVDRSFDGTLGLSLLWVLRGWRRPDDVRVRPTAASLPGVEMVTATVAHIDIAAQVVHTDNSVIGYDALVIALGAALNTDAVPGLSDALDADVAGQFYTLDGAAELRAKVEALEHGRIAVAIAGVPFKCPAAPFEAAFLIAAQLGDRYATGTVQIDTFTPDPLPMPVAGPEVGEALVSMLKDHGVGFHPRKALARVDEAARTMHFGDGTSEPFDLLAVVPPHVPSAAARSAGLSESGWIPVDPRTLSTSADNVWAIGDATVLTLPNGKPLPKAAVFAEAQAAVVAHGVARHLGYDVAERHFTGTGACYVETGDHQAAKGDGDFFAPSAPSVTLYPPSREFHEEKVAQELAWLTRWKT

SEQ ID NO: 846 - DNA, 1344 bp, Mycobacterium tuberculosis
  CDS (4)..(1341)
tgaacacccgcgccgacgcggcgacaatcgcggaaaaccggtccgcgggaatgctgcgggccatgggccgataatagtttgactgactcggtcagtcaccccaagaccttgcgcaagactgcggcggaatctaatattccaaagatatatggaactcgatgcgaaggaatcaggctcatgagcaagacggttctcatccttggcgcgggtgtcggcggcctgaccaccgccgacaccctccgtcaactgctaccacctgaggatcgaatcatattggtggacaggagctttgacgggacgctgggcttgtcgttgctatgggtgttgcggggctggcggcggcctgacgacgtccgcgtccgccccaccgcggcgtcgctgcccggtgtggaaatggttactgcaaccgtcgcccacattgacatcgcggcccaggtagtgcacaccgacaacagcgtcatcggctatgacgcgttggtgatcgcattaggtgcggcgctgaacaccgacgccgttcccggactgtcggacgcgctcgacgccgacgtcgcgggccagttctacaccctggacggcgcggctgagctgcgtgcgaaggtcgaggcgctcgagcatggccggatcgctgtggctatcgccggggtgccgttcaaatgcccagccgcaccgttcgaagcggcgtttctgatcgccgcccaactcggtgaccgctacgccaccggaaccgtacagatcgacacgttcacgcctgacccgctgccgatgcccgttgcaggtcccgaggtcggcgaggctttggtctcgatgctcaaggatcacggtgtcggcttccatcctcgcaaggccctagctcgcgtcgatgaggccgcaaggacgatgcacttcggtgacggcacgtccgaaccgttcgatctgcttgccgtggtccccccgcacgtgccctccgccgcggcgcggtcagcgggtctcagcgaatccgggtggatacccgtggacccgcgcaccctgtccactagcgccgacaacgtgtgggccatcggcgatgcgaccgtgctgacgctgccgaatggcaaaccgctgcccaaggctgccgtgttcgccgaagcccaggccgcagttgtcgcccacggcgtcgcccgccatctcggttacgacgtagctgagcgccacttcaccggcacgggcgcctgctacgtcgagaccggtgatcaccaggcagccaagggcgacggcgatttcttcgctccgtcggcgccctcggtgacgctgtacccgccgtcgcgggagtttcacgaggagaaggtcgcacaagaactggcctggctgacccgctggaagacgtga

SEQ ID NO: 847 - protein, 446 aa, Mycobacterium tuberculosis
TPAPTRRQSRKTGPRECCGPWADNSLTDSVSHPKTLRKTAAESNIPKIYGTRCEGIRLMSKTVLILGAGVGGLTTADTLRQLLPPEDRIILVDRSFDGTLGLSLLWVLRGWRRPDDVRVRPTAASLPGVEMVTATVAHIDIAAQVVHTDNSVIGYDALVIALGAALNTDAVPGLSDALDADVAGQFYTLDGAAELRAKVEALEHGRIAVAIAGVPFKCPAAPFEAAFLIAAQLGDRYATGTVQIDTFTPDPLPMPVAGPEVGEALVSMLKDHGVGFHPRKALARVDEAARTMHFGDGTSEPFDLLAVVPPHVPSAAARSAGLSESGWIPVDPRTLSTSADNVWAIGDATVLTLPNGKPLPKAAVFAEAQAAVVAHGVARHLGYDVAERHFTGTGACYVETGDHQAAKGDGDFFAPSAPSVTLYPPSREFHEEKVAQELAWLTRWKT

SEQ ID NO: 848 - DNA, 1914 bp, Mycobacterium tuberculosis
  CDS (1)..(60)
  CDS (64)..(126)
  CDS (130)..(147)
  CDS (151)..(183)
  CDS (187)..(207)
  CDS (211)..(273)
  CDS (277)..(372)
  CDS (376)..(390)
  CDS (394)..(471)
  CDS (475)..(501)
  CDS (505)..(603)
  CDS (607)..(738)
  CDS (742)..(795)
  CDS (799)..(849)
  CDS (853)..(1914)
ccatctacaccgctcaacagccgggccagacgctgccggtcggtgctgccgagaaggcggtgatccgtggcgagttgttcatgtcgcggcgcaccaccgccgaccaacgggtgcttgccatccgtctgaccaacggtagttcgctgctgatctccaaaagtctcaagcccaccgaagcagtcatgaacaagctgcgttgggtgctattgatcgtgggtgggatcggggtggcggtcgccgcggtggccggggggatggtcacccgggccgggctgaggccggtgggccgcctcaccgaagcggccgagcgggtggcgcgaaccgacgacctgcggcccatccccgtcttcggcagcgacgaattggccaggctgacagaggcattcaatttaatgctgcgggcgctggccgagtcacgggaacggcaggcaaggctggttaccgacgccggacatgaattgcgtaccccgctaacgtcgctgcgcaccaatgtcgaactcttgatggcctcgatggccccgggggctccgcggctacccaagcaggagatggtcgacctgcgtgccgatgtgctggctcaaatcgaggaattgtccacactggtaggcgatttggtggacctgtcccgaggcgacgccggagaagtggtgcacgagccggtcgacatggctgacgtcgtcgaccgcagcctggagcgggtcaggcggcggcgcaacgatatccttttcgacgtcgaggtgattgggtggcaggtttatggcgataccgctggattgtcgcggatggcgcttaacctgatggacaacgccgcgaagtggagcccgccgggcggccacgtgggtgtcaggctgagccagctcgacgcgtcgcacgctgagctggtggtttccgaccgcggcccgggcattcccgtgcaggagcgccgtctggtgtttgaacggttttaccggtcggcatcggcacgggcgttgccgggttcgggcctcgggttggcgatcgtcaaacaggtggtgctcaaccacggcggattgctgcgcatcgaagacaccgacccaggcggccagccccctggaacgtcgatttacgtgctgctccccggccgtcggatgccgattccgcagcttcccggtgcgacggctggcgctcggagcacggacatcgagaactctcggggttcggcgaacgttatctcagtggaatctcagtccacgcgcgcaacctagttgtgcagttactgttgaaagccacacccatgccagtccacgcatggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggta

SEQ ID NO: 849 - protein, 20 aa, Mycobacterium tuberculosis
PSTPLNSRARRCRSVLPRRR

SEQ ID NO: 850 - protein, 21 aa, Mycobacterium tuberculosis
SVASCSCRGAPPPTNGCLPSV

SEQ ID NO: 851 - protein, 6 aa, Mycobacterium tuberculosis
PTVVRC

SEQ ID NO: 852 - protein, 11 aa, Mycobacterium tuberculosis
SPKVSSPPKQS

SEQ ID NO: 853 - protein, 7 aa, Mycobacterium tuberculosis
TSCVGCY

SEQ ID NO: 854 - protein, 21 aa, Mycobacterium tuberculosis
SWVGSGWRSPRWPGGWSPGPG

SEQ ID NO: 855 - protein, 32 aa, Mycobacterium tuberculosis
GRWAASPKRPSGWREPTTCGPSPSSAATNWPG

SEQ ID NO: 856 - protein, 5 aa, Mycobacterium tuberculosis
QRHSI

SEQ ID NO: 857 - protein, 26 aa, Mycobacterium tuberculosis
CCGRWPSHGNGRQGWLPTPDMNCVPR

SEQ ID NO: 858 - protein, 9 aa, Mycobacterium tuberculosis
RRCAPMSNS

SEQ ID NO: 859 - protein, 33 aa, Mycobacterium tuberculosis
WPRWPRGLRGYPSRRWSTCVPMCWLKSRNCPHW

SEQ ID NO: 860 - protein, 44 aa, Mycobacterium tuberculosis
AIWWTCPEATPEKWCTSRSTWLTSSTAAWSGSGGGATISFSTSR

SEQ ID NO: 861 - protein, 18 aa, Mycobacterium tuberculosis
LGGRFMAIPLDCRGWRLT

SEQ ID NO: 862 - protein, 17 aa, Mycobacterium tuberculosis
WTTPRSGARRAATWVSG

SEQ ID NO: 863 - protein, 354 aa, Mycobacterium tuberculosis
ASSTRRTLSWWFPTAARAFPCRSAVWCLNGFTGRHRHGRCRVRASGWRSSNRWCSTTADCCASKTPTQAASPLERRFTCCSPAVGCRFRSFPVRRLALGARTSRTLGVRRTLSQWNLSPRAQPSCAVTVESHTHASPRMAKLARVVGLVQEEQPSDMTNHPRYSPPPQQPGTPGYAQGQQQTYSQQFDWRYPPSPPPQPTQYRQPYEALGGTRPGLIPGVIPTMTPPPGMVRQRPRAGMLAIGAVTIAVVSAGIGGAAASLVGFNRAPAGPSGGPVAASAAPSIPAANMPPGSVEQVAAKVVPSVVMLETDLGRQSEEGSGIILSAEGLILTNNHVIAAAAKPPLGSPPPKTTV

SEQ ID NO: 864 - DNA, 1913 bp, Mycobacterium tuberculosis
  CDS (1)..(135)
  CDS (139)..(453)
  CDS (457)..(669)
  CDS (673)..(789)
  CDS (793)..(873)
  CDS (877)..(933)
  CDS (937)..(1284)
  CDS (1288)..(1293)
  CDS (1297)..(1320)
  CDS (1324)..(1497)
  CDS (1501)..(1509)
  CDS (1513)..(1521)
  CDS (1525)..(1584)
  CDS (1588)..(1590)
  CDS (1594)..(1836)
  CDS (1840)..(1842)
  CDS (1846)..(1857)
  CDS (1861)..(1911)
catctacaccgctcaacagccgggccagacgctgccggtcggtgctgccgagaaggcggtgatccgtggcgagttgttcatgtcgcggcgcaccaccgccgaccaacgggtgcttgccatccgtctgaccaacggtagttcgctgctgatctccaaaagtctcaagcccaccgaagcagtcatgaacaagctgcgttgggtgctattgatcgtgggtgggatcggggtggcggtcgccgcggtggccggggggatggtcacccgggccgggctgaggccggtgggccgcctcaccgaagcggccgagcgggtggcgcgaaccgacgacctgcggcccatccccgtcttcggcagcgacgaattggccaggctgacagaggcattcaatttaatgctgcgggcgctggccgagtcacgggaacggcaggcaaggctggttaccgacgccggacatgaattgcgtaccccgctaacgtcgctgcgcaccaatgtcgaactcttgatggcctcgatggccccgggggctccgcggctacccaagcaggagatggtcgacctgcgtgccgatgtgctggctcaaatcgaggaattgtccacactggtaggcgatttggtggacctgtcccgaggcgacgccggagaagtggtgcacgagccggtcgacatggctgacgtcgtcgaccgcagcctggagcgggtcaggcggcggcgcaacgatatccttttcgacgtcgaggtgattgggtggcaggtttatggcgataccgctggattgtcgcggatggcgcttaacctgatggacaacgccgcgaagtggagcccgccgggcggccacgtgggtgtcaggctgagccagctcgacgcgtcgcacgctgagctggtggtttccgaccgcggcccgggcattcccgtgcaggagcgccgtctggtgtttgaacggttttaccggtcggcatcggcacgggcgttgccgggttcgggcctcgggttggcgatcgtcaaacaggtggtgctcaaccacggcggattgctgcgcatcgaagacaccgacccaggcggccagccccctggaacgtcgatttacgtgctgctccccggccgtcggatgccgattccgcagcttcccggtgcgacggctggcgctcggagcacggacatcgagaactctcggggttcggcgaacgttatctcagtggaatctcagtccacgcgcgcaacctagttgtgcagttactgttgaaagccacacccatgccagtccacgcatggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggta

SEQ ID NO: 865 - protein, 45 aa, Mycobacterium tuberculosis
HLHRSTAGPDAAGRCCREGGDPWRVVHVAAHHRRPTGACHPSDQR

SEQ ID NO: 866 - protein, 105 aa, Mycobacterium tuberculosis
FAADLQKSQAHRSSHEQAALGAIDRGWDRGGGRRGGRGDGHPGRAEAGGPPHRSGRAGGANRRPAAHPRLRQRRIGQADRGIQFNAAGAGRVTGTAGKAGYRRRT

SEQ ID NO: 867 - protein, 71 aa, Mycobacterium tuberculosis
IAYPANVAAHQCRTLDGLDGPGGSAATQAGDGRPACRCAGSNRGIVHTGRRFGGPVPRRRRRSGARAGRHG

SEQ ID NO: 868 - protein, 39 aa, Mycobacterium tuberculosis
RRRPQPGAGQAAAQRYPFRRRGDWVAGLWRYRWIVADGA

SEQ ID NO: 869 - protein, 27 aa, Mycobacterium tuberculosis
PDGQRREVEPAGRPRGCQAEPARRVAR

SEQ ID NO: 870 - protein, 19 aa, Mycobacterium tuberculosis
AGGFRPRPGHSRAGAPSGV

SEQ ID NO: 871 - protein, 116 aa, Mycobacterium tuberculosis
TVLPVGIGTGVAGFGPRVGDRQTGGAQPRRIAAHRRHRPRRPAPWNVDLRAAPRPSDADSAASRCDGWRSEHGHRELSGFGERYLSGISVHARNLVVQLLLKATPMPVHAWPSWPE

SEQ ID NO: 872 - protein, 8 aa, Mycobacterium tuberculosis
YRKSNLAT

SEQ ID NO: 873 - protein, 58 aa, Mycobacterium tuberculosis
RITHGIRHRRSSREPQVMLRGSSKRTASSSTGVTHRPRPRSQPSTVNPTRRWVVPGRV

SEQ ID NO: 874 - protein, 20 aa, Mycobacterium tuberculosis
RPLLGWFANALVQACWPSAR

SEQ ID NO: 875 - protein, 81 aa, Mycobacterium tuberculosis
RWCPPASAARPHPWSGSTGHPPAPAAAQWLPARRQASPQQTCRRGRSNRWRPRWCPVSSCWKPIWAASRRRAPASFCLPRG

SEQ ID NO: 876 - protein, 4 aa, Mycobacterium tuberculosis
PTTT

SEQ ID NO: 877 - protein, 17 aa, Mycobacterium tuberculosis
SRRPPSLPWAVRRRKRR

SEQ ID NO: 878 - DNA, 1912 bp, Mycobacterium tuberculosis
  CDS (1)..(1218)
  CDS (1222)..(1236)
  CDS (1240)..(1311)
  CDS (1315)..(1911)
atctacaccgctcaacagccgggccagacgctgccggtcggtgctgccgagaaggcggtgatccgtggcgagttgttcatgtcgcggcgcaccaccgccgaccaacgggtgcttgccatccgtctgaccaacggtagttcgctgctgatctccaaaagtctcaagcccaccgaagcagtcatgaacaagctgcgttgggtgctattgatcgtgggtgggatcggggtggcggtcgccgcggtggccggggggatggtcacccgggccgggctgaggccggtgggccgcctcaccgaagcggccgagcgggtggcgcgaaccgacgacctgcggcccatccccgtcttcggcagcgacgaattggccaggctgacagaggcattcaatttaatgctgcgggcgctggccgagtcacgggaacggcaggcaaggctggttaccgacgccggacatgaattgcgtaccccgctaacgtcgctgcgcaccaatgtcgaactcttgatggcctcgatggccccgggggctccgcggctacccaagcaggagatggtcgacctgcgtgccgatgtgctggctcaaatcgaggaattgtccacactggtaggcgatttggtggacctgtcccgaggcgacgccggagaagtggtgcacgagccggtcgacatggctgacgtcgtcgaccgcagcctggagcgggtcaggcggcggcgcaacgatatccttttcgacgtcgaggtgattgggtggcaggtttatggcgataccgctggattgtcgcggatggcgcttaacctgatggacaacgccgcgaagtggagcccgccgggcggccacgtgggtgtcaggctgagccagctcgacgcgtcgcacgctgagctggtggtttccgaccgcggcccgggcattcccgtgcaggagcgccgtctggtgtttgaacggttttaccggtcggcatcggcacgggcgttgccgggttcgggcctcgggttggcgatcgtcaaacaggtggtgctcaaccacggcggattgctgcgcatcgaagacaccgacccaggcggccagccccctggaacgtcgatttacgtgctgctccccggccgtcggatgccgattccgcagcttcccggtgcgacggctggcgctcggagcacggacatcgagaactctcggggttcggcgaacgttatctcagtggaatctcagtccacgcgcgcaacctagttgtgcagttactgttgaaagccacacccatgccagtccacgcatggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggta

SEQ ID NO: 879 - protein, 406 aa, Mycobacterium tuberculosis
IYTAQQPGQTLPVGAAEKAVIRGELFMSRRTTADQRVLAIRLTNGSSLLISKSLKPTEAVMNKLRWVLLIVGGIGVAVAAVAGGMVTRAGLRPVGRLTEAAERVARTDDLRPIPVFGSDELARLTEAFNLMLRALAESRERQARLVTDAGHELRTPLTSLRTNVELLMASMAPGAPRLPKQEMVDLRADVLAQIEELSTLVGDLVDLSRGDAGEVVHEPVDMADVVDRSLERVRRRRNDILFDVEVIGWQVYGDTAGLSRMALNLMDNAAKWSPPGGHVGVRLSQLDASHAELVVSDRGPGIPVQERRLVFERFYRSASARALPGSGLGLAIVKQVVLNHGGLLRIEDTDPGGQPPGTSIYVLLPGRRMPIPQLPGATAGARSTDIENSRGSANVISVESQSTRAT

SEQ ID NO: 880 - protein, 5 aa, Mycobacterium tuberculosis
LCSYC

SEQ ID NO: 881 - protein, 24 aa, Mycobacterium tuberculosis
KPHPCQSTHGQVGPSSGPSTGRAT

SEQ ID NO: 882 - protein, 199 aa, Mycobacterium tuberculosis
RHDESPTVFATAAAAGNPRLCSGAAANVQPAVRLALPTVPAPAANPVPSTLRGVGWYPAGSDTWRDSDHDAPSWDGSPTPSCRHVGHRRGDDSGGVRRHRRRGRIPGRVQPGTRRPQRRPSGCQRGAKHPRSKHAAGVGRTGGGQGGAQCRHVGNRSGPPVGGGLRHHSVCRGADLDQQPRDRGGRQASPGQSAAENDG

SEQ ID NO: 883 - DNA, 1395 bp, Mycobacterium tuberculosis
  CDS (1)..(1392)
atggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggtaaccttctctgacgggcggaccgcacccttcacggtggtgggggctgaccccaccagtgatatcgccgtcgtccgtgttcagggcgtctccgggctcaccccgatctccctgggttcctcctcggacctgagggtcggtcagccggtgctggcgatcgggtcgccgctcggtttggagggcaccgtgaccacggggatcgtcagcgctctcaaccgtccagtgtcgacgaccggcgaggccggcaaccagaacaccgtgctggacgccattcagaccgacgccgcgatcaaccccggtaactccgggggcgcgctggtgaacatgaacgctcaactcgtcggagtcaactcggccattgccacgctgggcgcggactcagccgatgcgcagagcggctcgatcggtctcggttttgcgattccagtcgaccaggccaagcgcatcgccgacgagttgatcagcaccggcaaggcgtcacatgcctccctgggtgtgcaggtgaccaatgacaaagacaccctgggcgccaagatcgtcgaagtagtggccggtggtgctgccgcgaacgctggagtgccgaagggcgtcgttgtcaccaaggtcgacgaccgcccgatcaacagcgcggacgcgttggttgccgccgtgcggtccaaagcgccgggcgccacggtggcgctaacctttcaggatccctcgggcggtagccgcacagtgcaagtcaccctcggcaaggcggagcagtga

SEQ ID NO: 884 - protein, 464 aa, Mycobacterium tuberculosis
MAKLARVVGLVQEEQPSDMTNHPRYSPPPQQPGTPGYAQGQQQTYSQQFDWRYPPSPPPQPTQYRQPYEALGGTRPGLIPGVIPTMTPPPGMVRQRPRAGMLAIGAVTIAVVSAGIGGAAASLVGFNRAPAGPSGGPVAASAAPSIPAANMPPGSVEQVAAKVVPSVVMLETDLGRQSEEGSGIILSAEGLILTNNHVIAAAAKPPLGSPPPKTTVTFSDGRTAPFTVVGADPTSDIAVVRVQGVSGLTPISLGSSSDLRVGQPVLAIGSPLGLEGTVTTGIVSALNRPVSTTGEAGNQNTVLDAIQTDAAINPGNSGGALVNMNAQLVGVNSAIATLGADSADAQSGSIGLGFAIPVDQAKRIADELISTGKASHASLGVQVTNDKDTLGAKIVEVVAGGAAANAGVPKGVVVTKVDDRPINSADALVAAVRSKAPGATVALTFQDPSGGSRTVQVTLGKAEQ

SEQ ID NO: 885 - DNA, 1812 bp, Mycobacterium tuberculosis
  CDS (4)..(1809)
tgagccagctcgacgcgtcgcacgctgagctggtggtttccgaccgcggcccgggcattcccgtgcaggagcgccgtctggtgtttgaacggttttaccggtcggcatcggcacgggcgttgccgggttcgggcctcgggttggcgatcgtcaaacaggtggtgctcaaccacggcggattgctgcgcatcgaagacaccgacccaggcggccagccccctggaacgtcgatttacgtgctgctccccggccgtcggatgccgattccgcagcttcccggtgcgacggctggcgctcggagcacggacatcgagaactctcggggttcggcgaacgttatctcagtggaatctcagtccacgcgcgcaacctagttgtgcagttactgttgaaagccacacccatgccagtccacgcatggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggtaaccttctctgacgggcggaccgcacccttcacggtggtgggggctgaccccaccagtgatatcgccgtcgtccgtgttcagggcgtctccgggctcaccccgatctccctgggttcctcctcggacctgagggtcggtcagccggtgctggcgatcgggtcgccgctcggtttggagggcaccgtgaccacggggatcgtcagcgctctcaaccgtccagtgtcgacgaccggcgaggccggcaaccagaacaccgtgctggacgccattcagaccgacgccgcgatcaaccccggtaactccgggggcgcgctggtgaacatgaacgctcaactcgtcggagtcaactcggccattgccacgctgggcgcggactcagccgatgcgcagagcggctcgatcggtctcggttttgcgattccagtcgaccaggccaagcgcatcgccgacgagttgatcagcaccggcaaggcgtcacatgcctccctgggtgtgcaggtgaccaatgacaaagacaccctgggcgccaagatcgtcgaagtagtggccggtggtgctgccgcgaacgctggagtgccgaagggcgtcgttgtcaccaaggtcgacgaccgcccgatcaacagcgcggacgcgttggttgccgccgtgcggtccaaagcgccgggcgccacggtggcgctaacctttcaggatccctcgggcggtagccgcacagtgcaagtcaccctcggcaaggcggagcagtga

SEQ ID NO: 886 - protein, 602 aa, Mycobacterium tuberculosis
ASSTRRTLSWWFPTAARAFPCRSAVWCLNGFTGRHRHGRCRVRASGWRSSNRWCSTTADCCASKTPTQAASPLERRFTCCSPAVGCRFRSFPVRRLALGARTSRTLGVRRTLSQWNLSPRAQPSCAVTVESHTHASPRMAKLARVVGLVQEEQPSDMTNHPRYSPPPQQPGTPGYAQGQQQTYSQQFDWRYPPSPPPQPTQYRQPYEALGGTRPGLIPGVIPTMTPPPGMVRQRPRAGMLAIGAVTIAVVSAGIGGAAASLVGFNRAPAGPSGGPVAASAAPSIPAANMPPGSVEQVAAKVVPSVVMLETDLGRQSEEGSGIILSAEGLILTNNHVIAAAAKPPLGSPPPKTTVTFSDGRTAPFTVVGADPTSDIAVVRVQGVSGLTPISLGSSSDLRVGQPVLAIGSPLGLEGTVTTGIVSALNRPVSTTGEAGNQNTVLDAIQTDAAINPGNSGGALVNMNAQLVGVNSAIATLGADSADAQSGSIGLGFAIPVDQAKRIADELISTGKASHASLGVQVTNDKDTLGAKIVEVVAGGAAANAGVPKGVVVTKVDDRPINSADALVAAVRSKAPGATVALTFQDPSGGSRTVQVTLGKAEQ

SEQ ID NO: 887 - DNA, 1166 bp, Mycobacterium tuberculosis
  CDS (1)..(387)
  CDS (391)..(450)
  CDS (454)..(477)
  CDS (481)..(663)
  CDS (667)..(822)
  CDS (826)..(834)
  CDS (838)..(966)
  CDS (970)..(1164)
gatccggcggggcgggtgtcggcgcaggcgtggctggcggtcacggcggtgcgggcggtgccgccgggctgtggggcgccggcggcggcggtggcaatggcgggaacggcgccgatgccaacatcgtcagcggtggagacggtggcctcggcggtgccggtggcggtggcggatggctctacggcgacggcggggccggcggacacggcggacaaggcgcaatcggcctcggcggcggcgccggcggcgacgggggccagggcggcgccggccgcggactgtggggtactggcggcgccggcggacacggcgggcaaggcggtggtaccgggggcccaccgctgcccggtcaggcaggcatgggcgccgcgggtggcgccggtgggctgatcggcaacggcggggccggcggcgacggcggtgtcggcgcgtccggcggggtcgccggagtaggcggtgccggcgggaacgccatgctgatcgggcacggcggcgccggcggcgccggcggagacagcagtttcgctaatggcgcggccggcggcgcgggcggtgccggagggcacctcttcggcaatggcgggtccggcggccacggcggagccgtcacggccggcaacaccggtatcggtggcgccggcggcgtcggtggggacgccaggctgatcggccacggtggcgccggcggtgccggcggggaccgcgccggagccttggttggccgtgacggcgggcccggtgggaacgggggcgctggcggccagctatacggcaacggcggcgacggcgcccccggcaccggcggaacactgcaggcggcggtgagcggattggtgacggctttgttcggtgcacccggccaacccggcgacaccggccaacccggctagccccgatcaacgagggtttcggtgccggtccggggcatggccatccgctgagctggcgatctggactacgttggtgtagaaaaatcctgccgcccggacccttaaggctgggacaatttctgatagctaccccgacacaggaggttacgggatgagcaattcgcgccgccgctcactcaggtggtcatggttgctgagcgtgctggctgccgtcgggctgggcctggccacggcgccggcccaggcggccccgccggccttgtcgcaggaccggtt

SEQ ID NO: 888 - protein, 129 aa, Mycobacterium tuberculosis
DPAGRVSAQAWLAVTAVRAVPPGCGAPAAAVAMAGTAPMPTSSAVETVASAVPVAVADGSTATAGPADTADKAQSASAAAPAATGARAAPAADCGVLAAPADTAGKAVVPGAHRCPVRQAWAPRVAPVG

SEQ ID NO: 889 - protein, 20 aa, Mycobacterium tuberculosis
SATAGPAATAVSARPAGSPE

SEQ ID NO: 890 - protein, 8 aa, Mycobacterium tuberculosis
AVPAGTPC

SEQ ID NO: 891 - protein, 61 aa, Mycobacterium tuberculosis
SGTAAPAAPAETAVSLMARPAARAVPEGTSSAMAGPAATAEPSRPATPVSVAPAASVGTPG

SEQ ID NO: 892 - protein, 52 aa, Mycobacterium tuberculosis
SATVAPAVPAGTAPEPWLAVTAGPVGTGALAASYTATAATAPPAPAEHCRRR

SEQ ID NO: 893 - protein, 43 aa, Mycobacterium tuberculosis
RLCSVHPANPATPANPASPDQRGFRCRSGAWPSAELAIWTTLV

SEQ ID NO: 894 - protein, 65 aa, Mycobacterium tuberculosis
KNPAARTLKAGTISDSYPDTGGYGMSNSRRRSLRWSWLLSVLAAVGLGLATAPAQAAPPALSQDR

SEQ ID NO: 895 - DNA, 1165 bp, Mycobacterium tuberculosis
  CDS (1)..(525)
  CDS (529)..(723)
  CDS (727)..(1041)
  CDS (1045)..(1083)
  CDS (1087)..(1164)
atccggcggggcgggtgtcggcgcaggcgtggctggcggtcacggcggtgcgggcggtgccgccgggctgtggggcgccggcggcggcggtggcaatggcgggaacggcgccgatgccaacatcgtcagcggtggagacggtggcctcggcggtgccggtggcggtggcggatggctctacggcgacggcggggccggcggacacggcggacaaggcgcaatcggcctcggcggcggcgccggcggcgacgggggccagggcggcgccggccgcggactgtggggtactggcggcgccggcggacacggcgggcaaggcggtggtaccgggggcccaccgctgcccggtcaggcaggcatgggcgccgcgggtggcgccggtgggctgatcggcaacggcggggccggcggcgacggcggtgtcggcgcgtccggcggggtcgccggagtaggcggtgccggcgggaacgccatgctgatcgggcacggcggcgccggcggcgccggcggagacagcagtttcgctaatggcgcggccggcggcgcgggcggtgccggagggcacctcttcggcaatggcgggtccggcggccacggcggagccgtcacggccggcaacaccggtatcggtggcgccggcggcgtcggtggggacgccaggctgatcggccacggtggcgccggcggtgccggcggggaccgcgccggagccttggttggccgtgacggcgggcccggtgggaacgggggcgctggcggccagctatacggcaacggcggcgacggcgcccccggcaccggcggaacactgcaggcggcggtgagcggattggtgacggctttgttcggtgcacccggccaacccggcgacaccggccaacccggctagccccgatcaacgagggtttcggtgccggtccggggcatggccatccgctgagctggcgatctggactacgttggtgtagaaaaatcctgccgcccggacccttaaggctgggacaatttctgatagctaccccgacacaggaggttacgggatgagcaattcgcgccgccgctcactcaggtggtcatggttgctgagcgtgctggctgccgtcgggctgggcctggccacggcgccggcccaggcggccccgccggccttgtcgcaggaccggtt

SEQ ID NO: 896 - protein, 175 aa, Mycobacterium tuberculosis
IRRGGCRRRRGWRSRRCGRCRRAVGRRRRRWQWRERRRCQHRQRWRRWPRRCRWRWRMALRRRRGRRTRRTRRNRPRRRRRRRRGPGRRRPRTVGYWRRRRTRRARRWYRGPTAARSGRHGRRGWRRWADRQRRGRRRRRCRRVRRGRRSRRCRRERHADRARRRRRRRRRQQFR

SEQ ID NO: 897 - protein, 65 aa, Mycobacterium tuberculosis
WRGRRRGRCRRAPLRQWRVRRPRRSRHGRQHRYRWRRRRRWGRQADRPRWRRRCRRGPRRSLGWP

SEQ ID NO: 898 - protein, 105 aa, Mycobacterium tuberculosis
RRARWERGRWRPAIRQRRRRRPRHRRNTAGGGERIGDGFVRCTRPTRRHRPTRLAPINEGFGAGPGHGHPLSWRSGLRWCRKILPPGPLRLGQFLIATPTQEVTG

SEQ ID NO: 899 - protein, 13 aa, Mycobacterium tuberculosis
AIRAAAHSGGHGC

SEQ ID NO: 900 - protein, 26 aa, Mycobacterium tuberculosis
ACWLPSGWAWPRRRPRRPRRPCRRTG

SEQ ID NO: 901 - DNA, 1164 bp, Mycobacterium tuberculosis
  CDS (1)..(885)
  CDS (889)..(936)
  CDS (940)..(990)
  CDS (994)..(1008)
  CDS (1015)..(1164)
tccggcggggcgggtgtcggcgcaggcgtggctggcggtcacggcggtgcgggcggtgccgccgggctgtggggcgccggcggcggcggtggcaatggcgggaacggcgccgatgccaacatcgtcagcggtggagacggtggcctcggcggtgccggtggcggtggcggatggctctacggcgacggcggggccggcggacacggcggacaaggcgcaatcggcctcggcggcggcgccggcggcgacgggggccagggcggcgccggccgcggactgtggggtactggcggcgccggcggacacggcgggcaaggcggtggtaccgggggcccaccgctgcccggtcaggcaggcatgggcgccgcgggtggcgccggtgggctgatcggcaacggcggggccggcggcgacggcggtgtcggcgcgtccggcggggtcgccggagtaggcggtgccggcgggaacgccatgctgatcgggcacggcggcgccggcggcgccggcggagacagcagtttcgctaatggcgcggccggcggcgcgggcggtgccggagggcacctcttcggcaatggcgggtccggcggccacggcggagccgtcacggccggcaacaccggtatcggtggcgccggcggcgtcggtggggacgccaggctgatcggccacggtggcgccggcggtgccggcggggaccgcgccggagccttggttggccgtgacggcgggcccggtgggaacgggggcgctggcggccagctatacggcaacggcggcgacggcgcccccggcaccggcggaacactgcaggcggcggtgagcggattggtgacggctttgttcggtgcacccggccaacccggcgacaccggccaacccggctagccccgatcaacgagggtttcggtgccggtccggggcatggccatccgctgagctggcgatctggactacgttggtgtagaaaaatcctgccgcccggacccttaaggctgggacaatttctgatagctaccccgacacaggaggttacgggatgagcaattcgcgccgccgctcactcaggtggtcatggttgctgagcgtgctggctgccgtcgggctgggcctggccacggcgccggcccaggcggccccgccggccttgtcgcaggaccggtt

SEQ ID NO: 902 - protein, 295 aa, Mycobacterium tuberculosis
SGGAGVGAGVAGGHGGAGGAAGLWGAGGGGGNGGNGADANIVSGGDGGLGGAGGGGGWLYGDGGAGGHGGQGAIGLGGGAGGDGGQGGAGRGLWGTGGAGGHGGQGGGTGGPPLPGQAGMGAAGGAGGLIGNGGAGGDGGVGASGGVAGVGGAGGNAMLIGHGGAGGAGGDSSFANGAAGGAGGAGGHLFGNGGSGGHGGAVTAGNTGIGGAGGVGGDARLIGHGGAGGAGGDRAGALVGRDGGPGGNGGAGGQLYGNGGDGAPGTGGTLQAAVSGLVTALFGAPGQPGDTGQPG

SEQ ID NO: 903 - protein, 16 aa, Mycobacterium tuberculosis
PRSTRVSVPVRGMAIR

SEQ ID NO: 904 - protein, 17 aa, Mycobacterium tuberculosis
AGDLDYVGVEKSCRPDP

SEQ ID NO: 905 - protein, 5 aa, Mycobacterium tuberculosis
GWDNF

SEQ ID NO: 906 - protein, 50 aa, Mycobacterium tuberculosis
LPRHRRLRDEQFAPPLTQVVMVAERAGCRRAGPGHGAGPGGPAGLVAGPV

SEQ ID NO: 907 - DNA, 1068 bp, Mycobacterium tuberculosis
  CDS (1)..(1065)
atgagcaattcgcgccgccgctcactcaggtggtcatggttgctgagcgtgctggctgccgtcgggctgggcctggccacggcgccggcccaggcggccccgccggccttgtcgcaggaccggttcgccgacttccccgcgctgcccctcgacccgtccgcgatggtcgcccaagtggggccacaggtggtcaacatcaacaccaaactgggctacaacaacgccgtgggcgccgggaccggcatcgtcatcgatcccaacggtgtcgtgctgaccaacaaccacgtgatcgcgggcgccaccgacatcaatgcgttcagcgtcggctccggccaaacctacggcgtcgatgtggtcgggtatgaccgcacccaggatgtcgcggtgctgcagctgcgcggtgccggtggcctgccgtcggcggcgatcggtggcggcgtcgcggttggtgagcccgtcgtcgcgatgggcaacagcggtgggcagggcggaacgccccgtgcggtgcctggcagggtggtcgcgctcggccaaaccgtgcaggcgtcggattcgctgaccggtgccgaagagacattgaacgggttgatccagttcgatgccgcgatccagcccggtgattcgggcgggcccgtcgtcaacggcctaggacaggtggtcggtatgaacacggccgcgtccgataacttccagctgtcccagggtgggcagggattcgccattccgatcgggcaggcgatggcgatcgcgggccagatccgatcgggtggggggtcacccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggcctga

SEQ ID NO: 908 - protein, 355 aa, Mycobacterium tuberculosis
MSNSRRRSLRWSWLLSVLAAVGLGLATAPAQAAPPALSQDRFADFPALPLDPSAMVAQVGPQVVNINTKLGYNNAVGAGTGIVIDPNGVVLTNNHVIAGATDINAFSVGSGQTYGVDVVGYDRTQDVAVLQLRGAGGLPSAAIGGGVAVGEPVVAMGNSGGQGGTPRAVPGRVVALGQTVQASDSLTGAEETLNGLIQFDAAIQPGDSGGPVVNGLGQVVGMNTAASDNFQLSQGGQGFAIPIGQAMAIAGQIRSGGGSPTVHIGPTAFLGLGVVDNNGNGARVQRVVGSAPAASLGISTGDVITAVDGAPINSATAMADALNGHHPGDVISVTWQTKSGGTRTGNVTLAEGPPA

SEQ ID NO: 909 - DNA, 1143 bp, Mycobacterium tuberculosis
  CDS (4)..(1140)
tagaaaaatcctgccgcccggacccttaaggctgggacaatttctgatagctaccccgacacaggaggttacgggatgagcaattcgcgccgccgctcactcaggtggtcatggttgctgagcgtgctggctgccgtcgggctgggcctggccacggcgccggcccaggcggccccgccggccttgtcgcaggaccggttcgccgacttccccgcgctgcccctcgacccgtccgcgatggtcgcccaagtggggccacaggtggtcaacatcaacaccaaactgggctacaacaacgccgtgggcgccgggaccggcatcgtcatcgatcccaacggtgtcgtgctgaccaacaaccacgtgatcgcgggcgccaccgacatcaatgcgttcagcgtcggctccggccaaacctacggcgtcgatgtggtcgggtatgaccgcacccaggatgtcgcggtgctgcagctgcgcggtgccggtggcctgccgtcggcggcgatcggtggcggcgtcgcggttggtgagcccgtcgtcgcgatgggcaacagcggtgggcagggcggaacgccccgtgcggtgcctggcagggtggtcgcgctcggccaaaccgtgcaggcgtcggattcgctgaccggtgccgaagagacattgaacgggttgatccagttcgatgccgcgatccagcccggtgattcgggcgggcccgtcgtcaacggcctaggacaggtggtcggtatgaacacggccgcgtccgataacttccagctgtcccagggtgggcagggattcgccattccgatcgggcaggcgatggcgatcgcgggccagatccgatcgggtggggggtcacccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggcctga

SEQ ID NO: 910 - protein, 379 aa, Mycobacterium tuberculosis
KNPAARTLKAGTISDSYPDTGGYGMSNSRRRSLRWSWLLSVLAAVGLGLATAPAQAAPPALSQDRFADFPALPLDPSAMVAQVGPQVVNINTKLGYNNAVGAGTGIVIDPNGVVLTNNHVIAGATDINAFSVGSGQTYGVDVVGYDRTQDVAVLQLRGAGGLPSAAIGGGVAVGEPVVAMGNSGGQGGTPRAVPGRVVALGQTVQASDSLTGAEETLNGLIQFDAAIQPGDSGGPVVNGLGQVVGMNTAASDNFQLSQGGQGFAIPIGQAMAIAGQIRSGGGSPTVHIGPTAFLGLGVVDNNGNGARVQRVVGSAPAASLGISTGDVITAVDGAPINSATAMADALNGHHPGDVISVTWQTKSGGTRTGNVTLAEGPPA

SEQ ID NO: 911 - DNA, 30 bp, Artificial Sequence
  Description of Artificial Sequence: Primer
gactgctgcagaaggagaagatccaaatgg

SEQ ID NO: 912 - DNA, 33 bp, Artificial Sequence
  Description of Artificial Sequence: Primer
gactagcggccgcgaattcgtcgacctccgagg

SEQ ID NO: 913 - DNA, 20 bp, Artificial Sequence
  Description of Artificial Sequence: Primer
ccgcggatccggatacgtac

SEQ ID NO: 914 - DNA, 31 bp, Artificial Sequence
  Description of Artificial Sequence: Primer
gactgctgcagtttatttcagccccagagcg

SEQ ID NO: 915 - DNA, 30 bp, Artificial Sequence
  Description of Artificial Sequence: Primer
gtaccagtactgatcacccgtctcccgcac

SEQ ID NO: 916 - DNA, 31 bp, Artificial Sequence
  Description of Artificial Sequence: Primer
agtcaggtacctcgcggaaggggtcagtgcg

SEQ ID NO: 917 - DNA, 31 bp, Artificial Sequence
  Description of Artificial Sequence: Primer
agtgcatgctgctggccgaaccatcagcgac

SEQ ID NO: 918 - DNA, 32 bp, Artificial Sequence
  Description of Artificial Sequence: Primer
cagccagatctgcgggcgccctgcaccgcctg

SEQ ID NO: 919 - DNA, 33 bp, Artificial Sequence
  Description of Artificial Sequence: Primer
ctggtcggtgcgtgcatgctcgcagccggatgc

SEQ ID NO: 920 - DNA, 30 bp, Artificial Sequence
  Description of Artificial Sequence: Primer
ataataccatgggcaagcagctagccgcgc

SEQ ID NO: 921 - DNA, 34 bp, Artificial Sequence
  Description of Artificial Sequence: Primer
atttatagatctctgcttagcaaccttggccgcg

SEQ ID NO: 922 - DNA, 44 bp, Artificial Sequence
  Description of Artificial Sequence: Primer
cgctctggggctcaaataaactgcagaaggagaagatccaaatg

SEQ ID NO: 923 - protein, 134 aa, Mycobacterium tuberculosis
PNTVRGGQAFVPGPASAADRLTEASMLLCQRGLGLDVPALAGPASSKQVELNDSRTETLEPRRRSGHQFDSALWQLKVSCEQPGDRIVGLAINRRLADVDNQLTVGTDLDQGSFVTAGLDADDHRVGHRLRLPF

SEQ ID NO: 924 - protein, 9 aa, Mycobacterium tuberculosis
PGAAWAPTT

SEQ ID NO: 925 - protein, 54 aa, Mycobacterium tuberculosis; identical to SEQ ID NO: 168

SEQ ID NO: 926 - protein, 29 aa, Mycobacterium tuberculosis
SHQPHSYHRACGFMPCIRDRGSRRTRRHT

SEQ ID NO: 927 - protein, 19 aa, Mycobacterium tuberculosis
SRLRRLPCRTDADASFRQP

SEQ ID NO: 928 - protein, 37 aa, Mycobacterium tuberculosis
ARSPPWQLQVLVHIFLSTNQPKRPSGPSTMNSSRRRC

SEQ ID NO: 929 - protein, 6 aa, Mycobacterium tuberculosis
PTCPAS

SEQ ID NO: 930 - protein, 12 aa, Mycobacterium tuberculosis
CPRYRRGCPSSG

SEQ ID NO: 931 - protein, 11 aa, Mycobacterium tuberculosis
GVGTQKHRRSA

SEQ ID NO: 932 - protein, 10 aa, Mycobacterium tuberculosis
RAGCDRCRSR

SEQ ID NO: 933 - protein, 24 aa, Mycobacterium tuberculosis
VRSVRASPTSPPEQVVVDASAMVD

SEQ ID NO: 934 - protein, 5 aa, Artificial Sequence
  Description of Artificial Sequence: Motif
LPISG

SEQ ID NO: 935 - protein, 5 aa, Artificial Sequence
  Description of Artificial Sequence: Motif
  MOD_RES (3): Any amino acid
LPXTG

The invention claimed is:

1. A recombinant screening, cloning, or expression vector that replicates in mycobacteria and that contains:
   1) a replicon, which is functional in mycobacteria;
   2) a selectable marker;
   3) a reporter cassette comprising:
      a) a multiple cloning site (polylinker),
      b) optionally a transcription terminator, which is active in mycobacteria, upstream of the polylinker,
      c) a coding nucleotide sequence, which is derived from a gene encoding a protein expression, export and/or secretion marker, said nucleotide sequence lacking its initiation codon and its regulatory sequences, and
      d) a coding nucleotide sequence derived from a gene encoding a marker for the activity of promoters, which are contained in the same fragment, said nucleotide sequence having its initiation codon,
   wherein the coding nucleotide sequence derived from a gene encoding a protein expression, export and/or secretion marker is a coding sequence derived from alkaline phosphatase phoA gene.

2. A recombinant screening, cloning, or expression vector that replicates in mycobacteria and that contains:
   1) a replicon, which is functional in mycobacteria;
   2) a selectable marker;
   3) a reporter cassette comprising:
      a) a multiple cloning site (polylinker),
      b) optionally a transcription terminator, which is active in mycobacteria, upstream of the polylinker,
      c) a coding nucleotide sequence, which is derived from a gene encoding a protein expression, export and/or secretion marker, said nucleotide sequence lacking its initiation codon and its regulatory sequences, and
      d) a coding nucleotide sequence derived from a gene encoding a marker for the activity of promoters, which are contained in the same fragment, said nucleotide sequence having its initiation codon.
   wherein the coding nucleotide sequence derived from a gene encoding a marker for the activity of promoters which are contained in the same fragment is a coding sequence derived from Green Fluorescent Protein ("GFP") gene.

3. A recombinant screening, cloning, or expression vector that replicates in mycobacteria and that contains:
   1) a replicon, which is functional in mycobacteria;
   2) a selectable marker;
   3) a reporter cassette comprising:
      a) a multiple cloning site (polylinker),
      b) optionally a transcription terminator, which is active in mycobacteria, upstream of the polylinker,
      c) a coding nucleotide sequence, which is derived from a gene encoding a protein expression, export and/or secretion marker, said nucleotide sequence lacking its initiation codon and its regulatory sequences, and
      d) a coding nucleotide sequence derived from a gene encoding a marker for the activity of promoters, which are contained in the same fragment, said nucleotide sequence having its initiation codon,
   wherein the vector is a plasmid chosen from the following plasmids, which have been deposited at the CNCM (Collection Nationale de Cultures de Microorganismes, Paris, France):
      a) pJVEDa which was deposited at the CNCM under the No. I-1797, on 12 Dec. 1996;
      b) pJVEDb which was deposited at the CNCM under the No. I-1906, on 25 Jul. 1997; and
      c) pJVEDc which was deposited at the CNCM under the No. I-1799, on 12 Dec. 1996.

4. A recombinant screening, cloning, or expression vector that replicates in mycobacteria and that contains:
   1) a replicon, which is functional in mycobacteria;
   2) a selectable marker;
   3) a reporter cassette comprising:
      a) a multiple cloning site (polylinker),
      b) optionally a transcription terminator, which is active in mycobacteria, upstream of the polylinker,
      c) a coding nucleotide sequence, which is derived from a gene encoding a protein expression, export and/or secretion marker, said nucleotide sequence lacking its initiation codon and its regulatory sequences, and
      d) a coding nucleotide sequence derived from a gene encoding a marker for the activity of promoters, which are contained in the same fragment, said nucleotide sequence having its initiation codon,
   wherein the *mycobacterium* is *M. tuberculosis*, and
   wherein the vector is a plasmid chosen from the following plasmids which have been deposited at the CNCM:
      a) p6D7, which was deposited on 28 Jan. 1997 at the CNCM under the No. I-1814;
      b) p5A3, which was deposited on 28 Jan. 1997 at the CNCM under the No. I-1815;
      c) p5F6, which was deposited on 28 Jan. 1997 at the CNCM under the No. I-1816;
      d) p2A29, which was deposited on 28 Jan. 1997 at the CNCM under the No. I-1817,
      e) pDP428, which was deposited on 28 Jan. 1997 at the CNCM under the No. I-1818,
      f) p5B5, which was deposited on 28 Jan. 1997 at the CNCM under the No. I-1819,
      g) p1 C7, which was deposited on 28 Jan. 1997 at the CNCM under the No. I-1820,
      h) p2D7, which was deposited on 28 Jan. 1997 at the CNCM under the No. I-1821,
      i) p1 B7, which was deposited on 31 Jan. 1997 at the CNCM under the No. I-1843, j) pJVED/*M. tuberculosis*, which was deposited on 25 Jul. 1997 at the CNCM under the No. I-1907, and k) pM 1025, which was deposited on 4 Aug. 1998 at the CNCM under the No. I-2062.

5. Recombinant vector according to claim 4, wherein the vector is plasmid pDP428, which was deposited on 28 Jan. 1997 at the CNCM under the No. I-1818.

* * * * *

UNITED STATES PATENT AND TRADEMARK OFFICE
CERTIFICATE OF CORRECTION

PATENT NO. : 7,244,613 B2  Page 1 of 1
APPLICATION NO. : 09/855604
DATED : July 17, 2007
INVENTOR(S) : Brigitte Gicquel et al.

It is certified that error appears in the above-identified patent and that said Letters Patent is hereby corrected as shown below:

Claim 4, col. 57, line 3, "k) pM 1025" should read --k) pM1C25--.

Signed and Sealed this

Ninth Day of October, 2007

JON W. DUDAS
*Director of the United States Patent and Trademark Office*

UNITED STATES PATENT AND TRADEMARK OFFICE
CERTIFICATE OF CORRECTION

PATENT NO. : 7,244,613 B2  Page 1 of 1
APPLICATION NO. : 09/855604
DATED : July 17, 2007
INVENTOR(S) : Brigitte Gicquel et al.

It is certified that error appears in the above-identified patent and that said Letters Patent is hereby corrected as shown below:

Column 7, line 23, "BgIII" should read --BglII--.

Column 13, line 38, "GAAVALLAEPSATGASDPCAASEEVARTVGSVA" should read --GAAVALLAEPSATGASDPCAASEVARTVGSVA--.

Column 18, line 30, "M.foatuitum" should read --M. fortuitum--.

Column 22, line 61, "introductic said sequences" should read --introduction of said sequences--.

Column 51, line 1, "Sequ nc SEQ ID NO: 545" should read --Sequence SEQ ID NO: 545--.

Column 56, lines 62 and 66, "g) p1_C7" should read --g) p1C7-- and i) "p1_B7" should read i)-- p1B7--.

Signed and Sealed this

Fifteenth Day of April, 2008

JON W. DUDAS
*Director of the United States Patent and Trademark Office*